(12) United States Patent
Maeder et al.

(10) Patent No.: US 11,339,437 B2
(45) Date of Patent: *May 24, 2022

(54) COMPOSITIONS AND METHODS FOR TREATING CEP290-ASSOCIATED DISEASE

(71) Applicant: EDITAS MEDICINE, INC., Cambridge, MA (US)

(72) Inventors: Morgan Lee Maeder, Jamaica Plain, MA (US); Rina J. Mepani, Belmont, CA (US); David A. Bumcrot, Belmont, CA (US); Shen Shen, Watertown, MA (US); Michael Stefanidakis, Brookline, MA (US)

(73) Assignee: EDITAS MEDICINE, INC., Cambridge, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 15/667,603

(22) Filed: Aug. 2, 2017

(65) Prior Publication Data

US 2018/0155789 A1 Jun. 7, 2018

Related U.S. Application Data

(63) Continuation-in-part of application No. 14/644,181, filed on Mar. 10, 2015.

(60) Provisional application No. 62/036,576, filed on Aug. 12, 2014, provisional application No. 61/950,733, filed on Mar. 10, 2014, provisional application No. 62/535,193, filed on Jul. 20, 2017, provisional application No. 62/503,800, filed on May 9, 2017, provisional application No. 62/443,568, filed on Jan. 6, 2017, provisional application No. 62/400,526, filed on Sep. 27, 2016, provisional application No. 62/370,202, filed on Aug. 2, 2016.

(51) Int. Cl.
*C12Q 1/6883* (2018.01)
*C12N 9/22* (2006.01)
*C12N 15/10* (2006.01)

(52) U.S. Cl.
CPC ........... *C12Q 1/6883* (2013.01); *C12N 9/22* (2013.01); *C12N 15/102* (2013.01); *C12N 2310/20* (2017.05)

(58) Field of Classification Search
None
See application file for complete search history.

(56) References Cited

U.S. PATENT DOCUMENTS

| | | | |
|---|---|---|---|
| 5,443,505 A | 8/1995 | Wong et al. | |
| 5,766,242 A | 6/1998 | Wong et al. | |
| 5,869,624 A * | 2/1999 | Hasel | C07K 14/005 424/184.1 |
| 6,251,090 B1 | 6/2001 | Avery et al. | |
| 6,299,895 B1 | 10/2001 | Hammang et al. | |
| 6,413,540 B1 | 7/2002 | Yaacobi | |
| 6,416,777 B1 | 7/2002 | Yaacobi | |
| 6,586,240 B1 | 7/2003 | Singer et al. | |
| 7,985,581 B2 * | 7/2011 | Pachuk | C12N 15/1131 435/320.1 |
| 8,697,359 B1 | 4/2014 | Zhang | |
| 8,771,945 B1 | 7/2014 | Zhang | |
| 8,795,965 B2 | 8/2014 | Zhang | |
| 8,865,406 B2 * | 10/2014 | Zhang | C12N 15/63 435/6.1 |
| 8,871,445 B2 | 10/2014 | Cong et al. | |
| 8,889,356 B2 | 11/2014 | Zhang | |
| 8,889,394 B2 | 11/2014 | Chalasani et al. | |
| 8,889,418 B2 | 11/2014 | Zhang et al. | |
| 8,895,308 B1 | 11/2014 | Zhang et al. | |
| 8,906,616 B2 | 12/2014 | Zhang et al. | |
| 8,932,814 B2 | 1/2015 | Cong et al. | |
| 8,945,839 B2 | 2/2015 | Zhang | |
| 8,993,233 B2 | 3/2015 | Zhang et al. | |
| 8,999,641 B2 | 4/2015 | Zhang et al. | |
| 9,163,259 B2 * | 10/2015 | Choi | A61K 48/005 |
| 9,322,037 B2 | 4/2016 | Liu et al. | |
| 9,499,847 B2 | 11/2016 | Porter et al. | |
| 9,938,521 B2 * | 4/2018 | Maeder | C12N 15/11 |
| 10,253,312 B2 | 4/2019 | Maeder et al. | |
| 11,028,388 B2 | 6/2021 | Maeder et al. | |
| 2003/0186238 A1 | 10/2003 | Allawi et al. | |
| 2007/0020627 A1 | 1/2007 | Barbas | |
| 2010/0055793 A1 | 3/2010 | Chandrasegaran et al. | |
| 2010/0055798 A1 | 3/2010 | Battersby | |
| 2010/0076057 A1 | 3/2010 | Sontheimer et al. | |
| 2011/0059502 A1 | 3/2011 | Chalasani | |
| 2011/0189776 A1 | 8/2011 | Terns et al. | |

(Continued)

FOREIGN PATENT DOCUMENTS

| | | |
|---|---|---|
| KR | 2001/0048693 A | 6/2001 |
| WO | 2000/040089 A1 | 7/2000 |

(Continued)

OTHER PUBLICATIONS

Kim, et al. (Online Oct. 2012) "Gene Therapy for Ocular Diseases", Genetic Diseases of the Eye, 2nd Ed., Editor Elias I. Traboulsi, MD., Published by Oxford University Press, Oxford, England, DOI: 10.1093/med/9780195326147.001.0001, 20 pages as printed. (Year: 2012).*

O'Reilly, et al. (2007) "RNA Interference-Mediated Suppression and Replacement of Human Rhodopsin In Vivo", The American Journal of Human Genetics, 81: 127-35. (Year: 2007).*

(Continued)

*Primary Examiner* — Robert M Kelly

(74) *Attorney, Agent, or Firm* — Perkins Coie LLP; Patrick Morris; Courtney Prochnow

(57) ABSTRACT

Compositions and methods for treatment of CEP290 related diseases are disclosed.

117 Claims, 93 Drawing Sheets

Specification includes a Sequence Listing.

(56) References Cited

U.S. PATENT DOCUMENTS

| | | |
|---|---|---|
| 2011/0223638 A1 | 9/2011 | Wiedenheft et al. |
| 2011/0236894 A1 | 9/2011 | Rao et al. |
| 2011/0301073 A1 | 12/2011 | Gregory et al. |
| 2012/0270273 A1 | 10/2012 | Zhang et al. |
| 2013/0130248 A1 | 5/2013 | Haurwitz et al. |
| 2013/0253040 A1 | 9/2013 | Miller et al. |
| 2014/0068797 A1 | 3/2014 | Doudna et al. |
| 2014/0163169 A1 | 6/2014 | Kitagawa et al. |
| 2014/0179770 A1 | 6/2014 | Zhang et al. |
| 2014/0242699 A1 | 8/2014 | Zhang |
| 2014/0309177 A1 | 10/2014 | Perez-Pinera et al. |
| 2014/0315985 A1 | 10/2014 | May et al. |
| 2014/0335620 A1 | 11/2014 | Zhang et al. |
| 2014/0342456 A1 | 11/2014 | Mali et al. |
| 2014/0342457 A1 | 11/2014 | Mali et al. |
| 2014/0342458 A1 | 11/2014 | Mali et al. |
| 2014/0356958 A1 | 12/2014 | Mali et al. |
| 2015/0056705 A1 | 2/2015 | Conway et al. |
| 2015/0232833 A1 | 8/2015 | Mali et al. |
| 2015/0252358 A1* | 9/2015 | Maeder ............ C12N 15/1024 424/93.2 |
| 2015/0259704 A1 | 9/2015 | Church et al. |
| 2016/0281111 A1 | 9/2016 | Cotta-Ramusino et al. |
| 2016/0324987 A1 | 11/2016 | Wang et al. |
| 2016/0340661 A1 | 11/2016 | Cong et al. |
| 2017/0058298 A1 | 3/2017 | Kennedy et al. |
| 2018/0291370 A1 | 10/2018 | Gersbach et al. |

FOREIGN PATENT DOCUMENTS

| | | | |
|---|---|---|---|
| WO | 2001/028474 A1 | 4/2001 | |
| WO | 2002/089767 A1 | 11/2002 | |
| WO | 2003/072788 A1 | 9/2003 | |
| WO | 2008/108989 A2 | 9/2008 | |
| WO | 2009/121536 A1 | 10/2009 | |
| WO | 2010/054108 A9 | 5/2010 | |
| WO | 2011/012724 A1 | 2/2011 | |
| WO | 2011/143124 A2 | 11/2011 | |
| WO | 2011/146121 A1 | 11/2011 | |
| WO | 2012/145601 A2 | 10/2012 | |
| WO | 2012/164565 A8 | 12/2012 | |
| WO | 2012/168435 A1 | 12/2012 | |
| WO | 2013/012674 A1 | 1/2013 | |
| WO | 2013/066438 A2 | 5/2013 | |
| WO | 2013/082519 A2 | 6/2013 | |
| WO | 2013/098244 A1 | 7/2013 | |
| WO | 2013/126794 A1 | 8/2013 | |
| WO | 2013/141680 A1 | 9/2013 | |
| WO | 2013/142578 A1 | 9/2013 | |
| WO | 2013/163628 A2 | 10/2013 | |
| WO | 2013/176772 A1 | 11/2013 | |
| WO | WO-2013176772 A1 * | 11/2013 | ............ A61P 43/00 |
| WO | 2013/181228 A1 | 12/2013 | |
| WO | 2014/018423 A8 | 1/2014 | |
| WO | 2014/022702 A2 | 2/2014 | |
| WO | 2014/036219 A2 | 3/2014 | |
| WO | 2014/059255 A1 | 4/2014 | |
| WO | 2014/065596 A1 | 5/2014 | |
| WO | 2014/089290 A1 | 6/2014 | |
| WO | 2014/093479 A1 | 6/2014 | |
| WO | 2014/093595 A1 | 6/2014 | |
| WO | 2014/093622 A8 | 6/2014 | |
| WO | 2014/093635 A9 | 6/2014 | |
| WO | 2014/093655 A2 | 6/2014 | |
| WO | 2014/093661 A2 | 6/2014 | |
| WO | 2014/093694 A1 | 6/2014 | |
| WO | 2014/093709 A1 | 6/2014 | |
| WO | 2014/093712 A1 | 6/2014 | |
| WO | 2014/093718 A1 | 6/2014 | |
| WO | 2014/099744 A1 | 6/2014 | |
| WO | 2014/099750 A2 | 6/2014 | |
| WO | 2014/124284 A1 | 8/2014 | |
| WO | 2014/144288 A1 | 9/2014 | |
| WO | 2014/144592 A2 | 9/2014 | |
| WO | 2014/144761 A2 | 9/2014 | |
| WO | 2014/152432 A2 | 9/2014 | |
| WO | 2014/186585 A2 | 11/2014 | |
| WO | 2014/197568 A2 | 12/2014 | |
| WO | 2014/197748 A2 | 12/2014 | |
| WO | 2014/204578 A1 | 12/2014 | |
| WO | 2014/204725 A8 | 12/2014 | |
| WO | 2014/204726 A1 | 12/2014 | |
| WO | 2015/006290 A1 | 1/2015 | |
| WO | 2015/006294 A2 | 1/2015 | |
| WO | 2015/006498 A2 | 1/2015 | |
| WO | 2015/013583 A8 | 1/2015 | |
| WO | 2015/020522 A1 | 2/2015 | |
| WO | 2015/021353 A1 | 2/2015 | |
| WO | 2015/027134 A1 | 2/2015 | |
| WO | 2015/035136 A8 | 3/2015 | |
| WO | 2015/035139 A2 | 3/2015 | |
| WO | 2015/035162 A2 | 3/2015 | |
| WO | 2015/048577 A2 | 4/2015 | |
| WO | 2015/048680 A1 | 4/2015 | |
| WO | 2015/070083 A1 | 5/2015 | |
| WO | 2015/071474 A9 | 5/2015 | |
| WO | 2015/077290 A2 | 5/2015 | |
| WO | 2015/077318 A1 | 5/2015 | |
| WO | 2015/089406 A1 | 6/2015 | |
| WO | 2015/089462 A1 | 6/2015 | |
| WO | 2015/099850 A1 | 7/2015 | |
| WO | 2015/138510 A8 | 9/2015 | |
| WO | 2015/188056 A1 | 12/2015 | |
| WO | 2015/195621 A1 | 12/2015 | |
| WO | 2016/022363 A9 | 2/2016 | |
| WO | 2016/073990 A2 | 5/2016 | |
| WO | 2016/182959 A1 | 11/2016 | |
| WO | 2016/186772 A2 | 11/2016 | |
| WO | 2016/205749 A1 | 12/2016 | |
| WO | 2017/035416 A2 | 3/2017 | |
| WO | 2017/184768 | 10/2017 | |
| WO | 2018/009562 A1 | 1/2018 | |
| WO | 2018/026976 A1 | 2/2018 | |
| WO | 2018/126176 A1 | 7/2018 | |

OTHER PUBLICATIONS

Peng, et al. (2015) "Potential pitfalls of CRISPR/Cas9-mediated genome editing", The FEBS Journal, 283: 1218-31. (Year: 2015).*
Jocelyn Kaiser (May 3, 2016) "The gene editor CRISPR won't fully fix sick people any time soon. Here's why.", Science, CRISPR, DOI: 10.1126/science.aaf5689, 5 pages long, found at http://www.sciencemag.org/news/2016/05/gene-editor-crispr-won-t-fully-fix-sick-people-anytime-soon-here-s-why, 12 pages. (Year: 2.*
Maeder, et al. (2016) "Therapeutic Correction of an LCA-Causing Splice Defect in the CEP290 Gene By CRISPR/Cas-Mediated Gene Editing", Molecular Therapy, 24(Suppl. 1): pp. S51-S52 (Abstract 124). (Year: 2016).*
https://ghr.nlm.nih.gov/condition/senior-loken-syndrome, no Authors listed,"Senior-Loken syndrome", Genetics Home Reference: Your Guide to Understanding Genetic Conditions, Published by NIH U.S. National Library of Medicine, Bethesda, MD, 5 pages as printed Jan. 22, 2019 (Year: 2019).*
Singh, et al. (2018) "Genes and genetics in eye diseases: a genomic medicine approach for investigating hereditary and inflammatory ocular disorders", International Journal of Opthamology, 11(1): 117-134.*
Weleber RG, Francis PJ, Trzupek KM, et al. Leber Congenital Amaurosis. Jul. 7, 2004 [Updated May 2, 2013]. In: Adam MP, Ardinger HH, Pagon RA, et al., editors. GeneReviews® [Internet]. Seattle (WA): University of Washington, Seattle; 1993-2019. Available from: https://www.ncbi.nlm.nih.gov/books/NBK1298/, 32 pages.*
Sobrevals, et al. (2012) "AAV vectors transduce hepatocytes in vivoas efficiently in cirrhotic as in healthy rat livers", Gene Therapy, 19: 411-17. (Year: 2012).*
Li, et al. (2009) "Gene therapy following subretinal AAV5 vector delivery is not affected by a previous intravitreal AAV5 vector administration in the partner eye", Molecular Vision, 15: 267-75. (Year: 2009).*

(56) References Cited

OTHER PUBLICATIONS

Vandenberghe, et al. (2011) "Dosage Thresholds for AAV2 and AAV8 Photoreceptor Gene Therapy in Monkey", Science Translational Medicine, 3(88): article 88ra54, 9 pages long. (Year: 2011).*
Lopes, et al. (2013) "Retinal gene therapy with large MYO7A cDNA using adeno-associated virus", Gene Therapy, 20: 824-33. (Year: 2013).*
Nishimasu, et al. (2015) "Crystal Structure of *Staphylococcus aureus* Cas9", Cell, 162: 1113-26. (Year: 2015).*
Boye, S. E., et al., "The Human Rhodopsin Kinase Promoter in an AAV5 Vector Confers Rod- and Cone-Specific Expression in the Primate Retina," Human Gene Therapy 23(10):1101-1115 (2012).
Maeder, M. L., et al., "Therapeutic Correction of an LCA-Causing Splice Defect in the CEP290 Gene by CRISPR/Cas-Mediated Gene Editing," Presented at the American Society of Gene and cell Therapy Annual Meeting, May 4-7, 2016 in Washington, DC, XP055418197, retrieved from: http://www.editasmedicine.com/data/documents/ASGCT.
Maeder, M. L., et al., "Therapeutic Correction of an LCA-Causing Splice Defect in the CEP290 Gene by CRISPR/Cas-Mediated Genome Editing," Mol. Ther. 23(Suppl. 1):S273-S274 (2015).
European Patent Office, International Search Report and Written Opinion dated Oct. 26, 2017 for PCT/US2017/045191.
Joung, J., et al., "Genome-Scale CRISPR-Cas9 Knockout and Transcriptional Activation Screening," Nat. Protoc. 12(4):828-863 (2017).
Koike-Yusa, H., et al., "Genome-Wide Recessive Genetic Screening in Mammalian Cells with a Lentiviral CRISPR-Guide RNA Library," Nat. Biotechnol. 32(3):267-273 (2014).
Shalem, O., et al., "Genome-Scale CRISPR-Cas9 Knockout Screening in Human Cells," Science 343:84 (2014).
U.S. Appl. No. 61/613,373, filed Mar. 20, 2012, Siksnys et al.
U.S. Appl. No. 61/625,420, filed Apr. 17, 2012, Siksnys et al.
U.S. Appl. No. 61/652,086, filed May 25, 2012, Jinek et al.
U.S. Appl. No. 61/716,256, filed Oct. 19, 2012, Jinek et al.
U.S. Appl. No. 61/734,256, filed Dec. 6, 2012, Chen et al.
U.S. Appl. No. 61/735,876, filed Dec. 11, 2012, Wiedenheft.
U.S. Appl. No. 61/736,527, filed Dec. 12, 2012, Zhang et al.
U.S. Appl. No. 61/738,355, filed Dec. 17, 2012, Church et al.
U.S. Appl. No. 61/758,624, filed Jan. 30, 2013, Chen et al.
U.S. Appl. No. 61/761,046, filed Feb. 5, 2013, Knight et al.
U.S. Appl. No. 61/779,169, filed Mar. 13, 2013, Mali et al.
U.S. Appl. No. 61/794,422, filed Mar. 15, 2013, Knight et al.
U.S. Appl. No. 61/799,531, filed Mar. 15, 2013, Wiedenheft.
U.S. Appl. No. 61/950,733, filed Mar. 10, 2014, Maeder et al.
U.S. Appl. No. 62/036,576, filed Aug. 12, 2014, Maeder et al.
U.S. Appl. No. 62/443,212.
Al-Attar, S., et al., "Clustered Regularly Interspaced Short Palindromic Repeats (CRISPRs) The Hallmark of an Ingenious Antiviral Defense Mechanism in Prokaryotes," Biol. Chem. 392:277-289 (2011).
Altschul, S. F., et al., "Gapped BLAST and PSI-BLAST: A New Generation of Protein Database Search Programs," Nucleic Acids Res. 25(17):3389-3402 (1997).
Altschul, S. F., et al., "Basic Local Alignment Search Tool," J. Mol. Biol. 215(3):403-410 (1990).
Ambati, J., et al., "Diffusion of High Molecular Weight Compounds Through Sclera," Invest. Ophthalmol. Vis. Sci. 41(5):1181-1185 (2000).
Ambati, J., et al., "Transscleral Delivery of Bioactive Protein to the Choroid and Retina," Invest. Ophthalmol. Vis. Sci. 41(5):1186-1191 (2000).
Anders, C., et al., "Structural Basis of PAM-Dependent Target DNA Recognition by the Cas9 Endonuclease," Nature 513(7519):569-573 (2014).
Andreas, S., et al., "Enhanced Efficiency Through Nuclear Localization Signal Fusion on Phage PhiC31-Integrase: Activity Comparison with Cre and FLPe Recombinase in Mammalian Cells," Nucleic Acids Res. 30(11):2299-2306 (2002).
Anonymous, Third Party Observation for EP13818570.7, Oct. 1, 2014, 15 pages.
Anonymous, Third Party Observation for EP13824232.6, Sep. 8, 2014, 48 pages.
Anonymous, Third Party Observation for EP13824232.6, Sep. 22, 2014, 19 pages.
Anonymous, Third Party Observation for EP13824232.6, Oct. 22, 2014, 7 pages.
Baala, L., et al., "Pleiotropic Effects of CEP290 (NPHP6) Mutations Extend to Meckel Syndrome," Am. J. Hum. Genet. 81(1):170-179 (2007).
Bae, S., et al., "Cas-OFFinder: A Fast and Versatile Algorithm that Searches for Potential Off-Target Sites of Cas9 RNA-Guided Endonucleases," Bioinformatics 30(10):1473-1475 (2014).
Bainbridge, J.W., et al., "Effect of Gene Therapy on Visual Function in Leber's Congenital Amaurosis," N. Engl. J. Med. 358(21):2231-2239 (2008).
Baker, M., "Gene Editing at CRISPR Speed," Nat. Biotechnol. 32(4):309-312 (2014).
Barker, C. S., et al., "Increased DNA Microarray Hybridization Specificity Using sscDNA Targets," BMC Genomics 6:57 (2005).
Baron-Benhamou, J., et al., "Using the LambdaN Peptide to Tether Proteins to RNAs," Methods Mol. Biol. 257:135-153 (2004).
Barrangou, R., "RNA-Mediated Programmable DNA Cleavage," Nat. Biotechnol. 30(9):836-838 (2012).
Barretina, J., et al., "The Cancer Cell Line Encyclopedia Enables Predictive Modeling of Anticancer Drug Sensitivity," Nature 483(7391):603-607 (2012).
Bassett, A. R., et al., "CRISPR/Cas9 and Genome Editing in *Drosophila*," J. Genet. Genom. 41:7-19 (2014).
Beerli, R. R., et al., "Toward Controlling Gene Expresion at Will: Specific Regulation of the erbB-2/HER-2 Promoter by Using Polydactyl Zinc Finger Proteins Constructed from Modular Building Blocks," Proc. Natl. Acad. Sci. 95:14628-14633 (1998).
Bhaya, D., et al., "CRISPR-Cas Systems in Bacteria and Archaea: Versatile Small RNAs for Adaptive Defense and Regulation," Annu. Rev. Genet. 45:273-297 (2011).
Bikard, D., et al., "Programmable Repression and Activation of Bacterial Gene Expression Using an Engineered CRISPR-Cas System," Nucl. Acids Res. 41(15):7429-7437 (2013).
Bitinaite, J., et al., "FokI Dimerization is Required for DNA Cleavage," Proc. Natl. Acad. Sci. 95:10570-10575 (1998).
Boch, J., et al., "Breaking the Code of DNA Binding Specificity of TAL-Type III Effectors," Science 326(5959):1509-1512 (2009).
Boch, J., et al., "Xanthomonas AvrBs3 Family-Type III Effectors: Discovery and Function," Annu. Rev. Phytopathol. 48:419-436 (2010).
Bothmer, A., et al., "Characterization of the Interplay Between DNA Repair and CRISPR/Cas9-Induced DNA Lesions at an Endogenous Locus," Nat. Commun. 8:13905 (2017).
Briner, A.E., et al., "Guide RNA Functional Modules Direct Cas9 Activity and Orthogonality," Mol. Cell 56(2):333-339 (2014).
Broad Institute, Communication Forwarding Declaration of Feng Zhang for U.S. Appl. No. 14/256,912, filed Nov. 24, 2014, 5 pages.
Broad Institute, Information Disclosure Statement submitted for U.S. Appl. No. 14/256,912, citing Electronic Mail from T. Kowalski which references Briner et al., Nov. 3, 2014, 8 pages.
Broad Institute, Request for Oral Examination for EP13818570.7, Oct. 27, 2014, 3 pages.
Broad Institute, Response to EP Examination Report for EP13824232.6, dated Dec. 31, 2014, 44 pages.
Broad Institute, Response to Third Party Observations and Request for Oral Hearing for EP13824232.6, Oct. 27, 2014, 9 pages.
Broad Institute, Response to Third Party Observations, with redlined and clean amended claims, for EP13818570.7, Oct. 16, 2014, 30 pages.
Broad Institute, Response to Third Party Observations, with redlined and clean amended claims, for EP13824232.6, Oct. 2, 2014, 16 pages.
Brummelkamp, T. R., et al., "A System for Stable Expression of Short Interfering RNAs in Mammalian Cells," Science 296(5567):550-553 (2002).
Burnight, E.R., et al., "CEP290 Gene Transfer Rescues Leber Congenital Amaurosis Cellular Phenotype," Gene Ther. 21:662-672 (2014).

(56) References Cited

OTHER PUBLICATIONS

Caldecott, K.W., "Single-Strand Break Repairand Genetic Disease," Nat. Rev. Genet. 9(8):619-631 (2008).
Canver, M. C., "Evaluation of the Clinical Success of Ex Vivo and In Vivo Gene Therapy," Journal of Young Investitgators, http://www.hyi.org/issue/evaluation-of-the-clinical-success-of-ex-vivo-and-in-vivo-gene-therapy/, 9 pages (2009).
Carroll, D., "A CRISPR Approach to Gene Targeting," Mol. Ther. 20(9):1658-1660 (2012).
Cathomen, T., et al., "Zinc-Finger Nucleases: The Next Generation Emerges," Mol. Ther. 16:1200-1207 (2008).
Cermak, T., et al., "Efficient Design and Assembly of Custom TALEN and Other TAL Effector-Based Constructs for DNA Targeting," Nucl. Acids Res. 39(12):e82 (2011).
Chen, X., et al., "Fusion Protein Linkers: Property, Design and Functionality," Adv. Drug Deliv. Rev. 65(10):1357-1369 (2013).
Chen, F., et al., "Targeted Activation of Diverse CRISPR-Cas Systems for Mammalian Genome Editing Via Proximal CRISPR Targeting," Nat. Commun. 8:14958 (2017).
Cho, S. W., et al., Supplementary Information: Targeted Genome Engineering in Human Cells With the Cas9 RNA-Guided Endonuclease, Nature Biotechnology (Mar. 2013) vol. 31, No. 3, 11 pages.
Cho, S. W., et al., "Targeted Genome Engineering in Human Cells with the Cas9 RNA-Guided Endonuclease," Nat. Biotechnol. 31(3):230-232 (2013).
Christian, M., et al., "Targeting DNA Double-Strand Breaks With TAL Effector Nucleases," Genetics 186:757-761 (2010).
Christian, M., et al., "Targeting DNA Double-Strand Breaks With TAL Effector Nucleases," Genetics Supporting Information, 1SI-8SI (2010).
Chylinski, K., et al., "The TrackRNA and Cas9 Families of Type II CRISPR-Cas Immunity Systems," RNA Biol. 10(5):726-737 (2013).
Cideciyan, A.V., et al., "Human Gene Therapy for RPE65 Isomerase Deficiency Activates the Retinoid Cycle of Vision but with Slow Rod Kinetics," Proc. Natl. Acad. Sci. U.S.A. 105(39):15112-15117 (2008).
Cong, L., et al., "Multiplex Genome Engineering Using CRISPR/Cas Systems," Science 339(6121):819-823 (2013).
Cong, L. et al., "Supplementary Material: Multiplex Genome Engineering Using CRISPR-Cas Systems," Science Express (Jul. 5, 2012).
Cong, L. et al., "Supplementary Material: Multiplex Genome Engineering Using CRISPR-Cas Systems," Science Express (Jan. 3, 2013).
Coppieters, F., et al., "Genetic Screening of LCA in Belgium: Predominance of CEP290 and Identification of Potential Modifier Alleles in AHI1 of CEP290-Related Phenotypes," Hum. Mutat. 31(10):E1709-1766 (2010).
Cornish-Bowden, A., "Nomenclature for Incompletely Specified Bases in Nucleic Acid Sequences: Recommendations 1984," Nucleic Acids Res. 13(9):3021-3030 (1985).
Cradick, T. J., et al., "CRISPR/Cas9 Systems Targeting Beta-Globin and CCR5 Genes Have Substantial Off-Target Activity," Nucleic Acids Res. 41(20):9584-9592 (2013).
Datsenko, K. A., et al., "Molecular Memory of Prior Infections Activates the CRISPR/Cas Adaptive Bacterial Immunity System," Nat. Commun. 3:945 (2012).
Davis, L., et al., "Homology-Directed Repair of DNA Nicks Via Pathways Distinct from Canonical Double-Strand Break Repair," PNAS 111(10):E924-932 (2014).
Deltcheva, E., et al., CRISPR RNA Maturation by Trans-Encoded Small RNA and Host Factor RNase III, Nature 471:602-607 (2011).
Deltcheva, E., et al., Supplementary Figures: CRISPR RNA Maturation by Trans-Encoded Small RNA and Host Factor RNase III. Downloaded from www.nature.com/nature, p. 1-35, 2011.
Den Hollander, A.I., et al., "Mutations in the CEP290 (NPH6) Gene are a Frequent Cause of Leber Congenital Amaurosis," Am. J. Hum. Genet. 79(3):556-561 (2006).
Den Hollander, A.I., et al., "Leber Congenital Amaurosis: Genes, Proteins and Disease Mechanisms," Prog. Retin. Eye Res. 27(4):391-419 (2008).
Den Hollander, A.I., et al., "Lighting a Candle in the Dark: Advances in Genetics and Gene Therapy of Recessive Retinal Dystrophies," J. Clin. Invest. 120(9):3042-3053 (2010).
Deveau, H., et al., "Phage Response to CRISPR-Encoded Resistance in *Streptococcus thermophilus*," J. Bacteriol. 190(4):1390-1400 (2008).
Dicarlo, J. E., et al., "Genome Engineering in *Saccharomyces cerevisiae* Using CRISPR-Cas Systems," Nucl. Acids Res. 41(7):4336-43 (2013).
Dingwall, C., et al., "A Polypeptide Domain That Specifies Migration of Nucleoplasmin Into the Nucleus," Cell 30:449-458 (1982).
Dreszer, T. R., et al., "The UCSC Genome Browser Database: Extensions and Updates 2011," Nucl. Acids Res. 40:D918-D923 (2012).
Estrada-Cuzcano, A., et al., "IQCB1 Mutations in Patients with Leber Congenital Amaurosis," Invest. Opthalmol. Vis. Sci. 52(2):834-839 (2011).
Esvelt, K.M., et al., "A System for the Continuous Directed Evolution of Biomolecules," Nature 472(7344):499-503 (2011).
Esvelt, K. M., et al., "Orthogonal Cas9 Proteins for RNA-Guided Gene Regulation and Editing," Nat. Methods 10(11):1116-1121 (2013).
Fine, E.J., et al., "Trans-Spliced Cas9 Allows Cleavage of HBB and CCR5 Genes in Human Cells Using Compact Expression Cassettes," Sci. Rep. 5:10777 (2015).
Fonfara, I., et al., "Phylogeny of Cas9 Determines Functional Exchangeability of Dual-RNA and Cas9 Among Orthologous Type II CRISPR-Cas Systems," Nucl. Acids Res.42(4):2577-2590 (2014).
Friedland, A.E., et al., "Characterization of *Staphylococcus aureus* Cas9: A Smaller Cas9 for All-in-One Adeno-Associated Virus Delivery and Paired Nickase Applications," Genome Biol. 16:257 (2015).
Frit, P., et al., "Alternative End-Joining Pathway(s): Bricolage at DNA Breaks," DNA Repair (Amst) 17:81-97 (2014).
Fu, Y., et al., "High-Frequency Off-Target Mutagenesis Induced by CRISPR-Cas Nucleases in Human Cells," Nat. Biotechnol. 31:822-826 (2013).
Fu, Y., et al., "Improving CRISPR-Cas Nuclease Specificity Using Truncated Guide RNAs," Nat. Biotechnol. 32(3):279-284 (2014).
Gabriel, R., et al., "An Unbiased Genome-Wide Analysis of Zinc-Finger Nuclease Specificity," Nat. Biotechnol. 29:816-823 (2011).
Garanto, A., et al., "Unexpected CEP290 mRNA Splicing in a Humanized Knock-In Mouse Model for Leber Congenital Amaurosis," PLoS One 8(11):e79369 (2013).
Garneau, J. E., et al., "The CRISPR-Cas Bacterial Immune Systems Cleaves Bacteriophage and Plasmid DNA," Nature 468:67-71 (2010).
Gasiunas, G., et al., "Cas9-crRNA Ribonucleoprotein Complex Mediates Specific DNA Cleavage for Adaptive Immunity in Bacteria," Proc. Natl. Acad. Sci. 109(39):E2579-E2586 (2012).
Gilbert, L. A., et al., "CRISPR-Mediated Modular RNA-Guided Regulation of Transcription in Eukaryotes," Cell 154(2):442-451 (2013).
Goldfarb, D. S., et al., "Synthetic Peptides as Nuclear Localization Signals," Nature 322:641-644 (1986).
Gratz, S. J., et al., "Genome Engineering of *Drosophila* with the CRISPR RNA-Guided Cas9 Nuclease," Genetics 194(4):1029-1035 (2013).
Guilinger, J. P., et al., "Fusion of Catalytically Inactive Cas9 to FokI Nuclease Improves the Specificity of Genome Modification," Nat Biotechnol. 32(6):577-583 (2014).
Gustafsson, C., et al., "Codon Bias and Heterologous Protein Expression," Trends Biotechnol. 22(7):346-353 (2004).
Haft, D. H., et al., "A Guild of 45 CRISPR-Associated (Cas) Protein Families and Multiple CRISPR/Cas Subtypes Exist in Prokaryotic Genomes," PLoS Comput. Biol. 1(6):e60 (2005).
Hale, C. R., et al., "Essential Features and Rational Design of CRISPR RNAs That Function With the Cas RAMP Module Complex to Cleave RNAs," Mol. Cell 45(3):292-302 (2012).
Hatoum-Aslan, A., et al. "Mature Clustered Regularly Interspaced, Short Palindromic Repeats RNA 5,9,14 (crRNA) Length is Mea-

(56) References Cited

OTHER PUBLICATIONS sured by a Ruler Mechanism Anchored at the Precursor Processing Site," Proc. Natl. Acad. Sci. 108(52):21218-21222 (2011).
Heigwer, F., et al., "E-CRISP: Fast CRISPR Target Site Identification," Nat. Methods 11(2):122-123 (2014).
Helou, J., et al., "Mutation Analysis of NPHP6/CEP290 in Patients with Joubert Syndrome and Senior-Loken Syndrome," J. Med. Genet. 44(10):657-663 (2007).
Hinz, J. M., et al., "Nucleosomes Selectively Inhibit Cas9 Off-Target Activity at a Site Located at the Nucleosome Edge," J. Biol. Chem. 291(48):24851-24856 (2016).
Hockemeyer, D., et al., "Efficient Targeting of Expressed and Silent Genes in Human ESCs and iPSCs Using Zinc-Finger Nucleases," Nat. Biotechnol. 27(9):851-857 (2009).
Hockemeyer, D., et al., "Genetic Engineering of Human luripotent Cells Using TALE Nucleases," Nat. Biotechnol. 29:731-734 (2011).
Holt, N, et al., "Zinc Finger Nuclease-Mediated CCR5 Konockout Hematopoietic Stem Cell Transplantation Controls HIV-1 In Vivo," Nat. Biotechnol. 28(8):839-847 (2010).
Horvath, P., et al., "CRISPR/Cas, The Immune System of Bacteria and Archaea," Science 327(5962):167-170 (2010).
Horvath, P., et al., "RNA-Guided Genome Editing A La Carte," Cell Res. 23:733-734 (2013).
Hou, Z., et al., "Efficient Genome Engineering in Human Pluripotent Stem Cells Using Cas9 from Neisseria Meningitidis," Proc. Natl. Acad. Sci. U.S.A. 110(39):15644-15649 (2013).
Hsu, P.D., et al., "DNA Targeting Specificity of RNA-Guided Cas9 Nucleases," Nat. Biotechnol. 31(9):827-832 (2013).
Hwang, W. Y., et al., "Heritable and Precise Zebrafish Genome Editing Using a CRISPR-Cas System," PLoS One 8(7):e68708 (2013).
Hwang, W. Y., et al., "Efficient Genome Editing in Zebrafish Using a CRISPR-Cas System," Nat. Biotechnol. 31(3):227-229 (2013).
Iyama, T., et al., "DNA Repair Mechanisms in Dividing and Non-Dividing Cells," DNA Repair (Amst.) 12(8):620-636 (2013).
Iyer, L. M., et al., "Prediction of Novel Families of Enzymes Involved in Oxidative and Other Complex Modifications of Bases in Nucleic Acids," Cell Cycle 8(11):1698-1710 (2009).
Jiang, W., et al., "RNA-Guided Editing of Bacterial Genomes Using CRISPR-Cas Systems," Nat. Biotechnol. 31(3):233-239 (2013).
Jinek, M., et al., "A Programmable Dual-RNA-Guided DNA Endonuclease in Adaptive Bacterial Immunity," Science 337(6096):816-821 (2012).
Jinek, M., et al., "Structures of Cas9 Endonucleases Reveal RNA-Mediated Conformational Activation," Science 343(6176):1247997 (2014).
Jinek, M., et al., "RNA-Programmed Genome Editing in Human Cells," eLife 2:e00471 (2013).
Kaiser, J., "The Gene Editor CRISPR Won't Fully Fix Sick People Anytime Soon. Here's Why," (May 3, 2016), Biol., Technol, CRISPR, DOI: 10.1126/science.aaf5689, 5 pages.
Karolchik, D., et al., "The UCSC Table Browser Data Retrieval Tool," Nucleic Acids Research 32:D493-496 (2004).
Kent, W. J., et al., "The Human Genome Browserat UCSC," Genome Research 12:996-1006 (2002).
Keryer-Bibens, C., et al., "Tethering of Proteins to RNAs by Bacteriophage Proteins," Biol. Cell, 100:125-138 (2008).
Khalil, A. S., et al., "Synthetic Biology: Applications Come of Age," Nat. Rev. Genet. 11(5):367-379 (2010).
Kim, Y.G., et al., "Hybrid Restriction Enzymes: Zinc Finger Fusions to Fok I Cleavage Domain," Proc. Natl. Acad. Sci. USA 93:1156-1160 (1996).
King, N. M.P., et al., "En Route to Ethical Recommendations for Gene Transfer Clinical Trials," Mol. Ther. 16(3):432-438 (2008).
Kleinstiver, B.P., et al., "Broadening the Targeting Range of *Staphylococcus aureus* CRISPR-Cas9 by Modifying PAM Recognition," Nat. Biotechnol. 33(12):1293-1298 (2015).
Kleinstiver, B.P., et al., "Engineered CRISPR-Cas9 Nucleases with Altered PAM Specificities," Nature 523(7561):481-485 (2015).

Kleinstiver, B.P., et al., "High-Fidelity CRISPR-Cas9 Nucleases with No Detectable Genome-Wide Off-Target Effects," Nature 529(7587):490-495 (2016).
Koenekoop, R.K., et al., "Genetic Testing for Retinal Dystrophies and Dysfunctions: Benefits, Dilemmas and Solutions," Clin. Exp. Ophthalmol. 35(5):473-485 (2007).
Komor, A.C., et al., "Programmable Editing of a Target Base in Genomic DNA Without Double-Stranded DNA Cleavage," Nature 533(7603):420-424 (2016).
Kosuri, S., et al., "A Scalable Gene Synthesis Platform Using High-Fidelity DNA Microchips," Nat. Biotechnol. 28(12):1295-1299 (2010).
Lambowitz, A. M., et al., "Group II Introns: Mobile Ribozymes that Invade DNA," Cold Spring Harb. Perspect. Biol. 3:a003616 (2011).
Langmead, B., et al., "Ultrafast and Memory-Efficient Alignment of Short DNA Sequences to the Human Genome," Genome Biology 10(3):R25 (2009).
Leber, T., "On Retinitis Pigmentosa and Congenital Amaurosis," Archiv fur Ophthalmologie 15(3):1-25 (1869).
Lee, J.H., et al., "A Robust Approach to Identifying Tissue-Specific Gene Expression Regulatory Variants Using Personalized Human Induced Pluripotent Stem Cells," PLoS Genetics 5(11):e1000718 (2009).
Lee, J., et al., "Non-Endocytic Delivery of Functional Engineered Nanoparticles into the Cytoplasm of Live Cells Using a Novel, High-Throughput Microfluidic Device," Nano Lett. 12(12):6322-6327 (2012).
Li, G.M., "Mechanisms and Functions of DNA Mismatch Repair," Cell Res. 18(1):85-98 (2008).
Li, T., et al., "TAL Nucleases (TALNs): Hybrid Proteins Composed of TAL Effectors and FokI DNA-Cleavage Domain," Nucl. Acids Res.39(1): 359-372 (2011).
Li, H., et al., "In Vivo Genome Editing Restores Hemostasis in a Mouse Model of Hemophilia," Nature 475(7355):217-221 (2011).
Li, T., et al., "Modularly Assembled Designer TAL Effector Nucleases for Targeted Gene Knockout and Gene Replacement in Eukaryotes," Nucl. Acids Res. 39(14):6315-6325 (2011).
Littink, K.W., et al., "A Novel Nonsense Mutation in CEP290 Induces Exon Skipping and Leads to a Relatively Mild Retinal Phenotype," Invest. Ophthalmol. Vis. Sci. 51(7):3646-3652 (2010).
Lombardo, A., et al., "Gene Editing in Human Stem Cells Using Xinc Finger Nucleases and Integrase-Defective Lentiviral Vector Delivery," Nat. Biotechnol. 25(11):1298-1306 (2007).
Lorenz, R., et al., "ViennaRNA Package 2.0," Algorithms for Molecular Biology 6:26 (2011).
Maeder, M. L., et al., "CRISPR RNA-Guided Activation of Endogenous Human Genes," Nat. Methods 10:977-979 (2013).
Maeder, M. L., et al., "Rapid "Open-Source" Engineering of Customized Zinc-Finger Nucleases for Highly Efficient Gene Modification," Mol. Cell 31(2):294-301 (2008).
Maeder, M. L., et al., "Therapeutic Correction of an LCA-Causing Splice Defect in the CEP290 Gene by CRISPR/Cas-Mediated Gene Editing," Mol. Ther. 24(Suppl. 1):S51-S52, Abstract 124 (2016).
Maguire, A.M., et al., "Safety and Efficacy of Gene Transfer for Leber's Congenital Amaurosis," N. Engl. J. Med. 358(21):2240-2248 (2008).
Maguire, A.M., et al., "Age-Dependent Effects of RPE65 Gene Therapy for Leber's Congenital Amaurosis: A Phase 1 Dose-Escalation Trial," Lancet 374(9701):1597-1605 (2009).
Makarova, K. S., et al., "A Putative RNA-Interference-Based Immune System in Prokaryotes Computational Analysis of the Predicted Enzymatic Machinery, Functional Analogies with Eukaryotic RNAi, and Hypothetical Mechanisms of Action," Biol. Direct. 1:7 (2006).
Makarova, K. S., et al., "Unification of Cas Protein Families and a Simple Scenario for the Origin and Evolution of CRISPR-Cas Systems," Biol. Direct 6:38 (2011).
Makarova, K.S., et al., "Evolution and Classification of the CRISPR-Cas Systems," Nat. Rev. Microbiol. 9(6):467-477 (2011).
Mali, P., et al., "CAS9 Transcriptional Activators for Target Specificity Screening and Paired Nickases for Cooperative Genome Engineering," Nat. Biotechnol. 31:833-838 (2013).
Mali, P., et al., "Cas9 as a Versatile Tool for Engineering Biology," Nat. Methods 10(10):957-963 (2013).

(56) References Cited

OTHER PUBLICATIONS

Mali, P., et al., "RNA-Guided Human Genome Engineering Via Cas9," Science 339(6121):823-826 (2013).
Marteijn, J.A., et al., "Understanding Nucleotide Excision Repairand Its Role in Cancer and Ageing," Nat. Rev. Mol. Cell Biol. 15(7):465-481 (2014).
Mathews, D. H., et al., "Expanded Sequence Dependence of Thermodynamic Parameters Improves Prediction of RNA Secondary Structure," J. Mol. Biol. 288:911-940 (1999).
Miller, J. C., et al., "An Improved Zinc-Finger Nuclease Architecture for Highly Specific Genome Editing," Nat. Biotechnol. 25:778-785 (2007).
Miller, J. C., et al., "A TALE Nuclease Architecture for Efficient Genome Editing," Nat. Biotechnol. 29(2):143-150 (2011).
Miyagishim M., et al., "U6 Promoter-Driven siRNAs with Four Uridine 3' Overhangs Efficiently Suppress Targeted Gene Expression in Mammalian Cells," Nat. Biotechnol. 20(5):497-500 (2002).
Moscou, M. J., et al., "A Simple Cipher Governs DNA Recognition by TAL Effectors," Science 326(5959):1501 (2009).
Myers, E. W., et al., "Optimal Alignments in Linear Space," Comput. Appl. Biosci. 4(1):11-17 (1988).
Nakamura, Y., et al., "Codon Usage Tabulated From International DNA Sequence Databases: Status for the Year 2000," Nucl. Acids Res. 28(1):292 (2000).
Needleman, S. B., et al., "A General Method Applicable to the Search for Similarities in the Amino Acid Sequence of Two Proteins," J. Mol. Biol. 48(3):443-453 (1970).
Nishimasu, H., et al., "Crystal Structure of Cas9 in Complex with Guide RNA and Target DNA," Cell 156(5):935-949 (2014).
Nishimasu, H., et al., "Crystal Structure of *Staphylococcus aureus* Cas9," Cell 162:1113-1126 (2015).
Pattanayak, V., et al., "High-Throughput Profiling of Off-Target DNA Cleavage Reveals RNA-Programmed Cas9 Nuclease Specificity," Nat. Biotechnol. 31:839-843 (2013).
Pattanayak, V., et al., "Revealing Off-Target Cleavage Specificities of Zinc-Finger Nucleases by In Vitro Selection," Nat. Methods 8:765-770 (2011).
Patterson, S. S., et al., "Codon Optimization of Bacterial Luciferase (lux) for Expression in Mammalian Cells," J. Ind. Microbio. Biotechnology 32:115-123 (2005).
Pearson, W. R., et al., "Improved Tools for Biological Sequence Comparison," Proc. Natl. Acad. Sci. U.S.A. 85(8):2444-2448 (1988).
Perez, E. E., et al., "Establishment of HIV-1 Resistance in CD4+ T Cells by Genome Editing Using Zinc-Finger Nucleases," Nat. Biotechnol. 26:808-816 (2008).
Perrault, I., et al., "Spectrum of NPHP6/CEP290 Mutations in Leber Congenital Amaurosis and Delineation of the Associated Phenotype," Hum. Mutat. 28(4):416 (2007).
Porteus, M. H., et al., "Gene Targeting Using Zinc Finger Nucleases," Nat. Biotechnol. 23(8):967-973 (2005).
Pougach, K., et al., "Transcription, Processing and Function of CRISPR Cassettes in *Escherichia coli*," Mol. Microbiol. 77(6):1367-1379 (2010).
Pride, D. T., et al., "Analysis of Streptococcal CRISPRs from Human Saliva Reveals Substantial Sequence Diversity Within and Between Subjects Over Time," Genome Res. 21:126-136 (2011).
Purnick, P. E. M., et al., "The Second Wave of Synthetic Biology: From Modules to Systems," Nat. Rev. Mol. Cell Biol. 10(6):410-422 (2009).
Qi, L. S., et al., "Repurposing CRISPR as an RNA-Guided Platform for Sequence-Specific Control of Gene Expression," Cell 152:1173-1183 (2013).
Qi, L., et al., "RNA Processing Enables Predictable Programming of Gene Expression," Nat. Biotechnol. 30(10):1002-1007 (2012).
Quinlan, A. R., et al., "BEDTools: A Flexible Suite of Utilities for Comparing Genomic Features," Bioinformatics 26(6):841-842 (2010).
Ran, F.A., et al., "Double Nicking by RNA-Guided CRISPR Cas9 for Enhanced Genome Editing Specificity," Cell 154(6):1380-1389 (2013).
Ran, F. A., et al., "In Vivo Genome Editing Using *Staphylococcus aureus* Cas9," Nature 520(7546):186-191 (2015).
Rand, T. A., et al., "Argonaute2 Cleaves the Anti-Guide Strand of siRNA During RISC Activation," Cell 123:621-629 (2005).
Rao, R. C., et al., "Cell and Gene Therapy," Dev. Ophthalmol. 53:167-177 (2014).
Raymond, C. S., et al., "High-Efficiency FLP and PhiC31 Site-Specific Recombination in Mammalian Cells," PLoS One 2(1):e162 (2007).
Rebar, E. J., et al., "Zinc Finger Phage: Affinity Selection of Fingers with New DNA-Binding Specificities," Science 263(5147):671-673 (1994).
Rebar, E. J., et al., "Induction of Angiogenesis in a Mouse Model Using Engineered Transcription Factors," Nat. Med. 8(12):1427-1432 (2008).
Regalado, A., "Who Owns the Biggest Biotech Discovery of the Century?," MIT Technology Review, Dec. 4, 2 014, http://www.technologyreview.com/featuredstory/532796/who-owns-the-biggest- -biotech-discovery-of-the-century/.
Reyon, D., et al., "FLASH Assembly of TALENs for High-Throughput Genome Editing," Nat. Biotech. 30:460-465 (2012).
Rho, M., et al. "Diverse CRISPRs Evolving in Human Microbiomes." PLoS Genetics 8(6):e1002441 (2012).
Richardson, C. D., et al., "Enhancing Homology-Directed Genome Editing by Catalytically Active and Inactive CRISPR-Cas9 Using Asymmetric Donor DNA," Nat. Biotechnol. 34(3):339-344 (2016).
Sander, J. D., et al., "Zinc Finger Targeter (ZiFiT): An Engineered Zinc Finger/Target Site Design Tool," Nucleic Acids Res. 35:W599-W605 (2007).
Sander, J. D., et al., "ZiFiT (Zinc Finger Targeter): An Updated Zinc Finger Engineering Tool," Nucleic Acids Res. 38:W462-468 (2010).
Sander, J. D., et al., "CRISPR-Cas Systems for Editing, Regulating and Targeting Genomes," Nat. Biotechnol. 32(4):347-355 (2014).
Sanders, R., "Cheap and Easy Technique to Snip DNA Could Revolutionize Gene Therapy", Berkeley News Online, pp. 1-3 (Jan. 7, 2013).
Sanjana, N. E., et al., "A Transcription Activator-Like Effector (TALE) Toolbox for Genome Engineering," Nat. Protoc. 7(1):171-192 (2012).
Sapranauskas, R., et al., "The *Streptococcus thermophilus* CRISPR-Cas System Provides Immunity in *Escherichia coli*," Nucl. Acids Res.39:9275-9282 (2011).
Sather, B. D., et al., "Efficient Modification of CCR5 in Primary Human Hematopoietic Cells Using a Mega TAL Nuclease and AAV Donor Template," Sci. Trans. Med. 7(307):307ra156 (2015).
Schramm, L., et al., "Recruitment of RNA Polymerase III to Its Target Promoters," Genes Devel. 16:2593-2620 (2002).
Selleck, W., et al., "Biophysical Characterization and Direct Delivery of S. Pyogenes Cas9 Ribonucleoprotein Complexes," Editas Medicine, Apr. 27, 2015, retrieved from URLhttp://www.editasmedicine.com/documents/ASGCT_poster_2015_Will.pdf.
Shanks, P., "CRISPR Opportunities . . . For What? And for Whom?," Biopolitical Times, Dec. 4, 2014, http://www.biopoliticaltimes.org/article.php?id=8235.
Shayakhmetov, D. M., et al., "Analysis of Adenovirus Sequestration in the Liver, Transduction of Hepatic Cells, and Innate Toxicity after Injection of Fiber-Modified Vectors," J. Virol. 78(10):5368-5381 (2004).
Shen, B., et al., "Generation of Gene-Modified Mice via Cas9/RNA-Mediated Gene Targeting," Cell Res. 23:720-723 (2013).
Shmakov, S., et al., "Discovery and Functional Characterization of Diverse Class 2 CRISPR-Cas Systems," Mol. Cell 60(3):385-397 (2015).
Smith, T. F., et al., "Comparison of Biosequences," Adv. Appl. Math. 2(4):482-489 (1981).
Smith, C., et al., "Efficient and Allele-Specific Genome Editing of Disease Loci in Human iPSCs," Mol. Ther. 23(3):570-577 (2015).
Sontheimer, E., "Project 7: Establishing RNA-Directed DNA Targeting in Eukaryotic Cells; Project dates: Nov. 16, 2011 to Dec. 31, 2012," Physical Sciences—Oncology Center (Feb. 4, 2012).
Sternberg, S.H., et al., "DNA Interrogation by the CRISPR RNA-Guided Endonuclease Cas9," Nature 507(7490):62-67 (2014).

(56) References Cited

OTHER PUBLICATIONS

Stone, E.M., "Leber Congenital Amaurosis—A Model for Efficient Genetic Testing of Heterogeneous Disorders: LXIV Edward Jackson Memorial Lecture," Am. J. Ophthalmol. 144(6):791-811 (2007).
Sugimoto, N., et al., "Thermodynamic Parameters to Predict Stability of RNA/DNA Hybrid Duplexes," Biochem. 34:11211-11216 (1995).
Sugimoto, N., et al., "Thermodynamics-Structure Relationship of Single Mismatches in RNA/DNA Duplexes," Biochem. 39(37):11270-11281 (2000).
Szczepek, M., et al., "Structure-Based Redesign of the Dimerization Interface Reduces the Toxicity of Zinc-Finger Nucleases," Nat. Biotechnol. 25:786-793 (2007).
Terns, M. P., et al., "CRISPR-based Adaptive Immune Systems," Curr. Opin. Microbiol. 14:321-327 (2011).
Thurman, R. E., et al., "The Accessible Chromatin Landscape of the Human Genome," Nature 489(7414):75-82 (2012).
Tolia, N. H., et al., "Slicer and the Argonautes," Nat. Chem. Biol. 3(1):36-43 (2007).
Tolpin, Thomas W., Third Party Observation for EP13793997.1, Jan. 6, 2015, 50 pages.
Tsai, S. Q., et al., "Dimeric CRISPR RNA-Guided FokI Nucleases for Highly Specific Genome Editing," Nat. Biotechnol. 32(6):569-576 (2014).
Tsai, S.Q., et al., "Open-Source GuideSeq Software for Analysis of GUIDE-Seq Data," Nat. Biotechnol. 34(5):483 (2016).
Urnov, F. D., et al., "Highly Efficient Endogenous Human Gene Correction Using Designed Zinc-Finger Nucleases," Nature 435:646-651 (2005).
Valente, E.M., et al., "Mutations of CEP290, Which Encodes a Centrosomal Protein, Cause Pleiotropic Forms of Joubert Syndrome," Nat. Genet. 38(6):623-625 (2006).
Van Der Oost, J., "New Tool for Genome Surgery," Science 336:768-768 (2013).
Van Der Ploeg, J. R., "Analysis of CRISPR in *Streptococcus mutans* Suggests Frequent Occurrence of Acquired Immunity Against Infection by M102-Like Bacteriophages," Microbiology 155:1966-1976 (2009).
Wang, H., et al., "One-Step Generation of Mice Carrying Mutations in Multiple Genes By CRISPR/Cas-Mediated Genome Engineering," Cell 153(4):910-918 (2013).
Wang, J., et al., "Homology-Driven Genome Editing in Hematopoietic Stem and Progenitor Cells Using ZFN mRNA and AAV6 Donors," Nat. Biotechnol. 33(12):1256-1263 (2015).
Wang, J., et al., "Highly Efficient Homology-Driven Genome Editing in Human T Cells by Combining Zinc-Finger Nuclease mRNA and AAV6 Donor Delivery," Nucleic Acids Res. 44(3):e30 (2016).
Wang, T., et al., "Genetic Screens in Human Cells Using the CRISPR-Cas9 System," Science 343(6166):80-84 (2013).
Wiedenheft, B., et al., "RNA-Guided Genetic Silencing Systems in Bacteria and Archaea," Nature 482:331-338 (2012).
Wu, X., et al., "Genome-Wide Binding of the CRISPR Endonuclease Cas9 in Mammalian Cells," Nat. Biotechnol. 32(7):670-676 (2014).
Wu, Y., et al., "Correction of a Genetic Disease in Mouse via Use of CRISPR-Cas9," Cell Stem Cell 13(6):659-662 (2013).
Xiao, A., et al., "CasOT: A Genome-Wide Cas9/gRNA Off-Target Searching Tool," Bioinformatics 30(8):1180-1182 (2014).
Yamano, T., et al., "Crystal Structure of Cpf1 in Complex with Guide RNA and Target DNA," Cell 165(4):949-962 (2016).
Yang, H., et al., "One-Step Generation of Mice Carrying Reporter and Conditional Alleles by CRISPR/Cas-Mediated Genome Engineering," Cell 154(6):1370-1390 (2013).
Yang, J., et al., Current Understanding of Usher Syndrome Type II, Front. Biosci. (Landmark Ed.) 17:1165-1183 (2012).
Zetsche, B., et al., "A Split-Cas9 Architecture for Inducible Genome Editing and Transcription Modulation," Nat. Biotechnol. 33(2):139-142 (2015).
Zetsche, B., et al., "Cpf1 Is a Single RNA-Guided Endonuclease of a Class 2 CRISPR-Cas System," Cell 163(3):759-771 (2015).
Zheng, A., et al., "Personalized Therapeutic Strategies for Patients with Retinitis Pigmentosa," Expert Opin. Biol. Ther. 15(3):391-402 (2015).
Zou, J., et al., "Gene Targeting of a Disease-Related Gene in Human Induced Pluripotent Stem and Embryonic Stem Cells," Cell Stem Cell 5(1):97-110 (2009).
Zou, J., et al., "Site-Specific Gene Correction of a Point Mutation in Human iPS Cells Derived from an Adult Patient with Sickle Cell Disease," Blood 118(17):4599-4608 (2011).
7th Annual 2014 Midwest Eye Research Symposium Program, Aug. 8, 2014, retrieved from: http://webeye.ophth.uiowa.edU/eig/MERS_2014.html#Back.
European Patent Office, International Search Report and Written Opinion dated Jun. 24, 2015 for PCT/US2015/019064.
European Patent Office, International Search Report and Written Opinion dated Jul. 1, 2015 for PCT/US2015/019790.
European Patent Office, International Search Report and Written Opinion dated Sep. 28, 2015 for PCT/US2015/022856.
European Patent Office, International Search Report and Written Opinion dated Jul. 31, 2015 for PCT/US2015/022851.
European Patent Office, International Search Report and Written Opinion dated Aug. 10, 2015 for PCT/US2015/023906.
European Patent Office, International Search Report and Written Opinion dated Jun. 12, 2017 for PCT/US2017/024163.
European Patent Office, International Search Report and Written Opinion dated Jul. 28, 2016 for PCT/US2016/029252.
European Patent Office, International Search Report and Written Opinion dated May 29, 2017 for PCT/US2017/022377.
European Patent Office, Examination Report for EP 13824232.6, dated Dec. 16, 2014, 4 pages.
United States Patent and Trademark Office, International Search Report and Written Opinion for PCT/US2013/075317, dated Apr. 15, 2014, 12 pages.
United States Patent and Trademark Office, International Search Report and Written Opinion for PCT/US2013/075326, dated Aug. 22, 2014, 13 pages.
United States Patent and Trademark Office, International Search Report and Written Opinion for PCT/US2014/027335, dated Jul. 16, 2014, 13 pages.
United States Patent and Trademark Office, International Search Report and Written Opinion for PCT/US2014/028630, dated Jul. 24, 2014, 9 pages.
United States Patent and Trademark Office, Invitation to Pay Additional Fees and, Where Applicable, Protest Fee for PCT/US2014/029068, dated Aug. 20, 2014, 3 pages.
United States Patent and Trademark Office, Office Action for U.S. Appl. No. 14/319,380, dated Jan. 28, 2015, 47 pages.
United States Patent and Trademark Office, Office Action for U.S. Appl. No. 14/319,530, dated Apr. 1, 2015, 23 pages.
Xu, Q., et al., "Design of 240,000 Orthogonal 25mer DNA Barcode Probes," Proc. Natl. Acad. Sci.106(7):2289-2294 (2009).
Amrani, N., et al., "NmeCas9 is an Intrinsically High-Fidelity Genome-Editing Platform," Genome Biol. 19:214 (2018).
Burstein, D., et al., "New CRISPR-Cas Systems from Uncultivated Microbes," Nature 542(7640):237-241 (2017).
Cassini, A., et al., "A Highly Specific SpCas9 Variant is Identified by In Vivo Screening in Yeast," Nat. Biotechnol. 36(3):265-271 (2018).
Chen, J. S., et al., "Enhanced Proofreading Governs CRISPR-Cas9 Targeting Accuracy," Nature 550(7676):407-410 (2017).
Cideciyan, A.V., et al., "Vision 1 Year After Gene Therapy for Leber's Congenital Amaurosis," N. Engl. J. Med. 361(7):725-727 (2009).
Fu, Y., et al., "Targeted Genome Editing in Human Cells Using CRISPR/Cas Nucleases and Truncated Guide RNAs," Methods Enzymol. 546:21-45 (2014).
Grieger, J. C., et al., "Production and Characterization of Adeno-Associated Viral Vectors," Nat. Protoc. 1(3):1412-1428 (2006).
Guo, X., et al., "RNA-Dependent Folding and Stabilization of C5 Protein During Assembly of the *E. coli* Rnase P Holoenzyme," J. Mol. Biol. 360:190-203 (2006).
Jain, A., et al., "CRISPR-Cas9-Based Treatment of Myocilin-Associated Glaucoma," PNAS 114(42):11199-11204 (2017).

(56) References Cited

OTHER PUBLICATIONS

Karvelis, T., et al., "crRNA and tracrRNA Guide Cas9-Mediated DNA Interference in *Streptococcus thermophilus*," RNA Biol. 10(5):841-851 (2013).
Kim, H.S., et al., "Problems Encountered in Detecting a Targeted Gene by the Polymerase Chain Reaction," Gene 103:227-233 (1991).
Kim, E., et al., "In Vivo Genome Editing with a Small Cas9 Orthologue Derived from Campylobacter Jejuni," Nat. Commun. 8:14500 (2017).
Lee, J. K., et al., "Directed evolution of CRISPR-Cas9 to Increase Its Specificity," Nat. Commun. 9:3048 (2018).
Liang, P., et al., "CRISPR/Cas9-Mediated Gene Editing in Human Tripronuclear Zygotes," Protein Cell 6(5):363-372 (2015).
Nishimasu, H., et al., "Engineered CRISPR-Cas9 Nuclease with Expanded Targeting Space," Science 361(6408):1259-1262 (2018).
Pellissier, L. P., et al., "Specific Tools for Targeting and Expression in Muller Glial Cells," Mol. Ther. Methods Clin. Dev. 1:14009 (2014).
Recht, M. I., et al., "Monitoring Assembly of Ribonucleoprotein Complexes by Isothermal Titration Calorimetry," Methods in Mol. Biol. 488:117-127 (2008).
Ruan, G.X., et al., "CRISPR/Cas9-Mediated Genome Editing as a Therapeutic Approach for Leber Congenital Amaurosis 10," Mol. Ther. 25(2):331-341 (2017).
Sharma, R., et al., "In Vivo Genome Editing of the Albumin Locus as a Platform for Protein Replacement Therapy," Blood 126(15):1777-1784 (2015).
Stone, E.M., et al., "Clinically Focused Molecular Investigation of 1000 Consecutive Families with Inherited Retinal Disease," Opthalmol. 124(9):1314-1331 (2017).
Strecker, J., et al., "Engineering of CRISPR-Cas12b for Human Genome Editing," Nat. Commun. 10:212 (2019).
Tang, L., et al., "CRISPR/Cas9-Mediated Gene Editing in Human Zygotes Using Cas9 Protein," Mol. Genet. Genom. 292(3):525-533 (2017).
Teng, F., et al., "Repurposing CRISPR-Cas12b for Mammalian Genome Engineering," Cell Discov. 4:63 (2018).
Truong, L. N., et al., "Microhomology-Mediated End Joining and Homologous Recombination Share the Initial End Resection Step to Repair DNA Double-Strand Breaks in Mammalian Cells," PNAS 110(19):7720-7725 (2013).
Van Overbeek, M., et al., "DNA Repair Profiling Reveals Nonrandom Outcomes at Cas9-Mediated Breaks," Mol. Cell 63:633-646 (2016).
Wang, J., et al., "xCas9 Expands the Scope of Genome Editing with Reduced Efficiency in Rice," Plant Biotechnol. J. 17:709-711 (2019).
Yan, W. X., et al., "Functionally Diversse Type V CRISPR-Cas Systems," Science 363:88-91 (2019).
Maeder, M. L., et al., "Development of a gene-editing approach to restore vision loss in Leber congenital amaurosis type 10," Nat. Med. 25(2):229-233 (2019).
Paix, A., et al., "Precision Genome Editing Using CRISPR-Cas9 and Linear Repair Templates in C. Elegans," Methods 121-121:86-93 (2017).
European Patent Office, International Search Report and Written Opinion dated Dec. 12, 2019 for PCT/US2019/040641.
Cramer, M. L., et al., "Induction of T-Cell Infiltration and Programmed Death Ligand 2 Expression by Adeno-Associated Virus in Rhesus Macaque Skeletal Muscle and Modulation by Prednisone," Hum. Gene Then 28(6):493-509 (2017).
Kumar, S. R.P., et al., "Clinical development of gene therapy: results and Tessons from recent successes," Mol. Ther. Methods Clin. Dev. 3:16034 (2016).

Xue, K., et al., "Technique of Retinal Gene Therapy: Delivery of Viral Vector Into the Subretinal Space," Eye 31 (9):1308-1316 (2017).
Yadav, S. P., et al., "The Transcription-Splicing Protein NonO/p54nrb and Three NonO-Interacting Proteins Bind to Distal Enhancer Region and Augment Rhodopsin Expression," Hum. Mol. Genet. 23(8):2132-2144 (2014).
Zetsche, B., et al., "Multiplex Gene Editing by CRISPR-Cpf1 Through Autonomous Processing of a Single crRNA Array," Nat. Biotechnol. 35(1):31-34 (2017).
Ding, Q., et al., "Enhanced Efficiency of Human Pluripotent Stem Cell Genme Editing through Replacing TALENs with CRIPSRs," Cell Stem Cell 12:393-394 (2013).
Heintze, J., et al., "A CRISPR CASe for High-Throughput Silencing," Front. Genet. 4(193):1-6 (2013).
Mukherjee-Clavin, B., et al., "Current Approaches for Efficient Genetic Editing in Human Pluripotent Stem Cells," Front. Biol. 8(5):461-467 (2013).
Bothmer, A., et al., "Detection and Modulation of DNA Translocations During Multi-Gene Genome Editing in T Cells," The CRISPR Journal 3(3):177-187 (2020).
Burnight, E. R., et al., "Using CRIPSR-Cas9 to Generate Gene-Corrected Autologous iPSCs for the Treatment of Inherited Retinal Degeneration," Mol. Ther. 25(9):1999-2013 (2017).
Cost, G. J., et al., Geneseq Accession No. BBD49192 (2014), 2 pages.
Fu, B. X. H., et al., "Landscape of Target: Guide Homology Effects on Cas9-Mediated Cleavage," Nucl. Acids Res. 42(22):13778-13787 (2014).
Giannoukos, G., et al., "UDiTaS™, a genome editing detection method for indels and genome rearrangements," BMC Genomics 19:212 (2018).
Kleinstiver, B. P., et al., "Engineered CRISPR-Cas12a variants with increased activities and improved targeting ranges for gene, epigenetic and base editing," Nat. Biotechnol. 37(3):276-282 (2019).
Kosicki, M., et al., "Repair of Double-Strand Breaks Induced by CRISPR-Cas9 Leads to Large Deletions and Complex Rearrangements," Nat. Biotechnol. 36(8):765-771 (2018).
Krieg, A. M., et al., GeneSeq Accession No. BAY71542 (2013).
Lee, J. H., et al., "Gene Therapy for Visual Loss: Opportunities and Concerns," Progress in Retinal and Eye Research 68:31-53 (2019).
Palisch, P., et al., "CRISPR-CasΦ from Huge Phages is a Hypercompact Genome Editor," Science ;369(6501):333-337 (2020).
Reeks, J., et al., "Structure of a Dimeric Crenarchaeal Cas6 Enzyme with an Atypical Active Site for CRISPR RNA Processing," Biochem. J. 452:223-230 (2013).
Reichel, F. F., et al., "AAV8 Can Induce Innate and Adaptive Immune Response in the Primate Eye," Mol. Ther. 25(12):2648-1660 (2017).
Strohkendl, I., et al., "Kinetic Basis for DNA Target Specificity of CRISPR-Cas12a," Mol Cell. 71(5):816-824 (2018).
Swarts, D. C., et al., "Cas9 Versus Cas12a/Cpf1: Structure-Function Comparisons and Implications for Genome Editing," WIREs RNA 9:e1481 (2018).
Vidigal, J. A., et al.,"Rapid and Efficient One-Step Generation of Paired gRNA CRISPR-Cas9 Libraries," Nat. Commun. 6:8083 (2015).
Weber, L., et al., "Editing a y-Globin Repressor Binding Site Restores Fetal Hemoglobin Synthesis and Corrects the Sickle Cell Disease Phenotype," Sci. Adv. 6:eaay9392 (2020).
Wu, W., et al., "Application of CRISPR-Cas9 in Eye Disease," Exp. Eye Res. 161:116-123 (2017).
European Patent Office, International Search Report and Written Opinion dated Jun. 17, 2020 for PCT/US2020/019766, 18 pages.

* cited by examiner

*Streptococcus thermophilus* a) Structure (See, e.g., Karvelis et al. RNA Biology. 2013; 10(5): 841-851)

```
CLUSTAL format alignment by MAFFT (v7.058b)
                                                        Y
                       *
SM         KKPYSIGLDIGTNSVGWAVITDDYKVPAKKMKVLGNTDKSHIEKNLLGALLFDSGNTAED
SP         DKKYSIGLDIGTNSVGWAVITDEYKVPSKKFKVLGNTDRHSIKKNLIGALLFDSGETAEA
ST         TKPYSIGLDIGTNSVGWAVITDNYKVPSKKMKVLGNTSKKYIKKNLLGVLLFDSGITAEG
LI         KKPYTIGLDIGTNSVGWAVLTDQYDLVKRKMKIAGDSEKKQIKKNPWGVRLFDEGQTAAD
            * *;***********  **;*.;  ;*;*;  *;;.;   *;**;  *, ***.* **
Motif:     -K-Y*IGLDIGTNSVGWAV-TD*Y-*---*K*K*-G**-.*--T*KN*-G---LFD-G-TA--

SM         RRLKRTARRRYTRRRNRILYLQEIFSEEMGKVDDSFFHRLEDSFLVTEDERGERHPIFGN
SP         TRLKRTARRRYTRRKNRICYLQEIFSNEMAKVDDSFFHRLEESFLVEEDKKHERHPIFGN
ST         RRLKRTARRRYTRRRNRILYLQEIFSTEMATLDDAFFQRLDDSFLVPDDKRDSKYPIFGN
LI         RRMARTARRRIERRRNRISYLQGIFAEEMSKTDANFFCRLSDSFYVDNEKRNSRHPPAT
            *;  ****** **;***  ***  **;  **.,  *   ** **,;**  *  ;;*;  ...;*,,
Motif:     -R*--RTARRR--RR*NRI-YLQ-IF*--EM---D--FF-RL-*SF-V-**K*---**P*F--

SM         LEEEVKYHENFPTIYHLRQYLADNPEKVDLRLVYLALAHIIKFRGHPLIEGKFDTRNNDV
SP         IVDEVAYHEKYPTIYHLRKELVDSTDKADLRLIYLALAHMIKFRGHFLIEGDLNPDNSDV
ST         LVEEKAYHDSFPTIYHLRKYLADSTKKADLRLVYLALAHMIKYRGHFLIEGSFNSKNNDI
LI         IEEEVEYHKNYPTIYHLRRELVNSSEKADLRLVYLALAHIIKYRGNFLIEGALDTQNTSV
            ; ;*  **.;;********;  *.;..,*.****;;*******;**;**;*****  ;;. *..;
Motif:     *--*E---YH-**PTIYHLR*-L-*----K-DLRL*YLALAH*IK*RGNFLIEG-**--N--*
```

FIG. 2B

```
SM         QELFQEFLAVYDNTFENSS------LQEQNVQVEEILTDKISKSAKKDRVLKLFPNEKSN
SP         DKLFIQLVQTYNQLFEENP------INASGVDAKAILSARLSKSERLENLIAQLPGEKKN
ST         QKNFQDFLDTYNAIFESDL------SLENSKQLEEIVKDKISKLEKKDRILKLFPGEKNS
LI         DGIYKQFIQTYNQVFASGIEDGSLKKLEDNKDVAKILVEKVTEKEELERILKLYPGEKSA
              :  ::: .*:  *  ..       .. :  *: :::: : ::: *.**.
Motif:     *--*-***--Y*--f-----------------*----I*--***--*-*-**---P-EK--

SM         GRFAEFLKLIVGNQADFKKHFELEEKAPLQFSKDTYEEELEVLLAQIGDNYAELFLSAKK
SP         GLFGNLIALSLGLTPNFKSNPDLAEDAKLQLSKDTYDDDLDNLLAQIGDQYADLFLAAKN
ST         GIPSEFLKLIVGNQADFREKCFNLDEKASLHFSKESYDEDLETLLGYIGDDYSDVFLKAKK
LI         GMFAQFISLIVGSKGNFQKPFDLIEKSDIECAEDSYEEDLESLLALIGDEYAELFVAAEN
             * *.::: *  :*  ;*:, *:* *,:  :, :*::*:::*:  **. ***;*::*:  **;
Motif:     G-F-***-L-*G---*F*--F*L-E-*-*---*KY*L*-LL--IGD*Y***F*-AK*

SM         LYDSILLSGILTVTDVGTKAPLSASMIQRYNEHQMDLAQLKQFIEQKLSDKYNEVFSDVS
SP         LSDAILLSDILEVNTEITKAPLSASMIKRYDEHHQDLTLLKALVRQQLPEKYKEIFFDQS
ST         LYDAILLSGFLTVTDNETEAPLSSAMIKRYNEHKEDLALLKEYIRNISLKTYNEVFKDDT
LI         AYSAVVLSSIITVAETETNAKLSASMIERFDTHEEDLGELKAFIKLHLPKHYEEIPSNTE
             .:::**:::  *    *:* **::*:*:: *, ** **  :: ,  *;*:*  ;
Motif:     ---***LS-**-V----T*A-LS**MI*R**-H--DL--LK--**-------Y*E*F-*--

SM         KDGYAGYIDGKTNQEAFYKYLKGLLNKIEGSGYFLDKIEREDFLRKQETFDNGSIPHQIH
SP         KNGYAGYIDGGASQEEFYKFIKPILEKMDGTEKLLVKLNREDLLRKQRTFDNGSIPHQIH
ST         KNGYAGYIDGKTNQEDFYVYLKKLLAEFEGADYFLEKIDREDFLRKQRTFDNGSIPYQIH
LI         KNGYAGYIDGKTKQADFYKYMKMTLENIEGADYFIAKIEKENFLRKQETFDNGAIPHQLH
            *.********   :,*   **   ** ;;* * ;;;*;  ::  *;:;*;;**********;**;*;*
Motif:     K-GYAGYIDG--Q---FY-K--L-***G*-----K*E**LRKQRTFDNG*IP*Q*H
```

FIG. 2C

```
SM       LQEMRAIIRRQAEFYPFLADNQDRIEKLLTFRIPYYVGPLARGKSDFAWLSRKSADKITP
SP       LGELRAILRRQEDFYPFLKDNREKIEKILTFRIPYYVGPLARGNSEFAWMTRKSEETITP
ST       LQEMRAILDKQAKFYPFLAKNKERIEKILTFRIPYYVGPLARGNSDFAWSIRKRNEKITP
LI       LEELEAILQQAKYYPFLKENYDKIKSLVTFEIPYFVGPLANGQSEFAWLTRKADGEIRP
         * *;:**; ;*  ;;**** .* ;;*;;;******,*****,*;*  ***   **    * *

Motif:   L-E*-AI*-*Q--*YPFL--N-**I*-**TFRIPY*VGPLA-G*S-FAW--RK----I-P

SM       WNFDEIVDKESSAEAFINRMTNYDLYLPNQKVLPKHSLLYEKPTVYNELTKVKYKTE-QG
SP       WNFEEVVDKGASAQSFIERMTNFDKNLPNEKVLPEHSLLYEYPTVYNELTKVKYVTEQMR
ST       WNFEDVIDKESSAEAFINRMTSFDLYLPEEKVLPEHSLLYETPNVYNELTKVRFIAESMR
LI       WNIEEKVDFGKSAVDFIEKMTNKDTYLPKENVLPKHSLCYQKYLVYNELTKVRYIND-QG
         **;;; ;*    **  **;;.**. *  **;;;******* *; ; *********;;  ;

Motif:   WN*-D---SA--PIMT--D--LP*VLPKHSL-Y*-*--VYNELTKV**-*---

SM       KTAFFDANMKQEIFDGVFKVYRKVTKDKLMDFLEKEFDRPRIVDLTGLDKENKVFNASYG
SP       KPAFLSGEQKKAIVDLLFETNRKVTVKQLKEDYPEKIECFDSVEISGVEDR---FNASLG
ST       DYQFLDSKQKKDIVRLYFEDKRKVTDKDIIEYL-HAIYGYDGIELKGIEKQ---FNSSLS
LI       KTSYFSGQEKEQIFNDLPKQKEKVKKDLELPL-RNMSHVESPTIEGLEDS---FNSSYS
           :  ::::; *; *.   **  ***. ;;           ;  :    **;*.

Motif:   ---**-*-*-R*-I*----FK--RKV----*-----*-*--------*-G**-----FN*S--

SM       TYHDLCKIL-DKDFLDNSKNEKILEDIVLTLTLFEDREMIRKRLENYSDLLTKEQVKKLE
SP       TYHDLLKIIKDKDFLDNEENEDILEDIVLTLTLFEDREMIEERLKTYAHLFDDKVMKQLK
ST       TYHDLLNIINDKEFLDDSSNEAIIEEIIHTLTIFEDREMIQRLSKFENIFDKSVLKKLS
LI       TYHDLLKVGIKQEILDNPVNTEMLENIVKILTVFEDKRMIKEQLQQFSDVLDGVVLKKLE
         *****;; ;;;;**; * ;;*;*; **;***;.**,;;*; ; ;;;    ;;*;*.

Motif:   TYHDL-**---***LD*--N--**E*I*--LT*FED*-MI-**L--*--**----*K*L-
```

FIG. 2D

```
SM          RRHYTSWGRLSAELERGIRNKESRKTILSYLIDDGSNRNFMQLINDDALSPKEEIAKAQ
SP          RRRYTGWGRLSEKLINGIRDKQSGKTILDFLKSDGFANRNFMQLIRDDSLTFKEDIQKAQ
ST          RRHYTGWGKLSAKLIHGIRDEKSGNTILDYLIDDGISNRNFMQLIHDDALSPKKKIQKAQ
LI          RRHYTSWGRLSAKLIMGIRDKQSHLTILDYLMNDDGLNRNLMQLINDGNLSFKSIIEKSQ
            **;*****;**;*;;***;;;**;****;**;*;**;***;****;**;***;*;***;*;***;***
Motif:      KR*YTSWG*LS--*L*--GIR***S---TILD*L---D---NRN*MQLI*D--L*FK--I-K-Q SM          VIGETD----NLKQVVSDIAGSPAIKKGILQSLKIVDELVKING--HQPEN[VVEMARE]KQFT
SP          VSGQSD----SLKEHIANLAGSPAIKKGILQTVEVVDSLVKVMGRHKPES[VIEMARE]KQTT
ST          IIGDEDKGSRIKEVVKSLPGSPAIKKGILQSIKIVDELVKVMGGRKPES[VVEMARE]KQYT
LI          VTTADK----DIQSIVADLAGSPAIKKGILQSLKIVDELVSVMG--YPPQT[VVEMARE]KQTT
            ;---;-;-;;;;;-**************;*;*****;**;---*;;;**;********;*
Motif:      *--------**---*---*--GSPAIKKGILQ**K*VDELV-*MG---P*--[V*EMARE]Q--T              [B]

SM          NQGRRNSQQRLKSLTDSIKEFGSQILKES------PVENSQLQMDRLFLYYLQNGRDMYT
SP          QKGQKNSRERNKRIBEGIKELGSQILKER------PVENTQLQNRKLYLYYLQNGRDMYV
ST          NQGKSNSQQRLKSLERSLKELGSKILKENIPARLSKIDNNALQMDRLYLYYLQNGKDMYT
LI          GKGKRNSKPRYKSLEKAIKEFGSQILKES------PTDNQELRNNRLYLYYLQNGKDMYT
            ;*;**;*;**;*;;;**;**;****;           ;*;**;;*;********;***;
Motif:      -*G---NS*-S-K-*-----KE*GS*ILKE*------*N---L*N**L*LYYLQNG*DMY-          [C]

SM          GEKLDIDYLSQY[DIEHIIPQAFIKDNSIENRVLTSSKEE]GKEDDVPSKDVRKMKSYWS
SP          DQELDINRLSDY[DVDHIVPQSFLKDSIDNKVLTRSDKE]RGKSDNVPSEKVVEKMKNYWR
ST          GDDLDIDRLSNY[DIDRIIPQAFLKDNSIDNKVLVSSASE]RGKSDDVPSLEVVKERKTFWT
LI          GQDLDIHNLSNY[DIDHIVPQSFITDNSIDNLVLTSSAGE]EKGDDVPLEIVRKEKVFWE
            ;;;***;-**;*[*;***;**;*;;*;****;**;;*  ]*;*;**;;;;;*;*;*;*
Motif:      --**LDI---LS*Y[D*DHI*PQ*F*--D*SIDN-VL---S]--KG-K-D*VP---**V*K-K--*W--
```

FIG. 2E

```
SM      KLLSAELITQRKFDNLTKAERGGLTDEDKAGFIKPQLVETRQITEHVARILDERPNTETD
SP      QLLNAKLITQREFDNLTKAERGGLSELDRAGFIERQLVETRQITKRVAQILDSRMNTEYD
ST      QLLKSELISQRKFDNLTKAERGGLSPEDKAGFIQRQLVETRQITEHVARLLDEKPNNRKD
LI      KLYQGNLMSKRKFDYLTKAERGGLTBADKARFIHRQLVETRQITKNVANILSQRFNYEKD
        :*  ..:*:;**** **********;  *** **;*************,**,;*..;*  :  *
Motif:  *L----*L***RKFD-LTKAERGGL*---DKA-FI*KQLVETRQITK*VA--*L--**N--*-D                    [9]

SM      SNNEKIRQVKIVTLKSNLVSNFRKEFELYKVREINDYRHAHDAYLNAVIGKALLGVYPQL
SP      SNDKLIREVKVITLKSELVSDFRKDFQFYKVREINNERHAHDAYLNAVVGTALIKKYPKL
ST      SNNRAVRFVKIITLKSTLVSQFRKDFELYKVREINDFRHAHDAYLNAVVASALLKKYPKL
LI      DHGNTMKQVRIVTLKSALVSQFRKQFQLYKVRDVNDVRHAHDAYLNGVVANTLLKVYPQL
        ::.. .;  *;;**** ***,***;*;;****;;*;;**********.*;..;*;  **;*
Motif:  -----V***TLKS-LVS*FRK*FLYKVN**RHAHDAYLN-V---*L*--YP*L SM      EPEFVYGDYPHPKGNKE-------NK-ATAKKFFYSNIMNFFKRDDVETD---------
SP      ESEFVYGDYKVYDVRKMIAKSEQEISK-ATARYPFYSNIMNFFKTRITLANGEIRKRPLI
ST      EPEFVYGDYPKYNSFRE--------RKSATEKVYFYSNIPMNIFKRSISLADGRVIERPLI
LI      EPEFVYGDYHQFDWFKA--------NK-ATAKKQFYTNIMLFFAQKDRIID--------
        *.*******   ;.  ;        *  ** *  **;***  ;*  .   ;    ;
Motif:  E-EPVYGDY--*----*----------K-AT-K--FY*NIM-*F---------*------

SM      ----KNGEIIWKKDEHISNIKKVLSYPQVNIVEKVEEQTGGFSKE--------SILPK
SP      ETNGETGEIYWDKGRDPATVREVLSMPQVNIVKETEVQTGGFSKE--------SILPK
ST      EVNEETGESVWNKESDLATVRRVLSYPQVNVVEKVEEQNRGLDRGKPKGLFRANLSSKPK
LI      ----ENGEILNDK-KYLDTVEKVMSYRQMNIVKKTEIQKGEFSKA--------TIKPK
            ;.** ;*;*   ;.;;;*;* *;*;***;* *.;  ;;;                ;  **
Motif:  ----*-GE-*W-K---*-***V*M--Q*N*VKK-E-Q----*--------*---PK
```

FIG. 2F

```
SM      GNSDK-LIPRKTKKFYWDTKKYGGFDSPIVAYSILVIADISKGKSKKLKTVKALVGVTIM
SP      RNSDK-LIARKKD---WDPKKYGSFDSPTVAYSVLVVAKVRKGKSKKLKSVKELLGITIM
ST      PMSNENLVGAKEY---LDPKKYGGYAGISNSPTVLVKGTIRKGAKKKITNVLEFQGISIL
LI      GNSSK-LIPRKTN---WDPMKYGGLDSPNMAYAVVI--EYAKGKN-KLVFEKKIIRVTIM
           **.; *.  *       *. ****  .  :::::::   **   *;    :  ::*:
Motif:  -NS-*-L*--K------D--KYGG---------*****-----KG---K*-----*--**I*

SM      EKMTFERDPVAFLEREGYRNVQEENIIKLPKYSLFKLENGRERLLAS------ARELQK
SP      ERSSFEKNPIDFLEAKGYKBVKKDLIIKLPKYSLFELENGRERMLAS------AGELQK
ST      DRINYRKDKLNPLLEKGYKDI--ELIIELPKYSLFELSDGSRRMLASILSTNNKRGEIHK
LI      ERKAFEEDEKAPLERQGYRQP--KVLAKLPKYTLYRCERGRRRMLAS------ANEAQK
        ::  :.::  **   :**::      .  :****:*::  :* :*:***         *  ;*
Motif:  **---*-**----FL---*GY**-----*--*LPKY*L**--*G--R*LAS--------E--*K SM      GNEIVLPNHLGTLLYHAKNIHKV------DEPKHLDYVDKHKDEFKELLDVVSNFSKKYT
SP      GNELALPSKYVNFLYLASHYEKLKGSPEDNEQKQL--FVEQHKHYLDEIIRQISEFSKEVI
ST      GNQIFLSQKFVELLYHAKRISNT------INENHREYVENHKKEFEELFYYILEFNENYV
LI      GNQQVLPNHLVTLLHHAANCEVS------DGKSLDYIESNREMFABLLAHVSEPAKRYT
        **;  *..:  ;*: *  .         :  :    :)):))., :*::   *:** :.
Motif:  GN*--L--*----*L*-A------------*-*----***-**---*-E**---*-*F-*---

SM      LAEGNLEKIKELYAQNNGEDLKELASSFI--------NLLTFTAIGAPATFKFFDKNIDR
SP      LADAMLDKVLSAYNKHRDKPIREQAENII--------HLFTLTNLGAPAAFKYFDTTIDR
ST      GAKKNGKLLNSAFQSWQNHSIDELCSSPIGPTGSERKGLFELTSRGSAADPEFLGVKIPR
LI      LAEANLNKINQLFEQNKEGDIKAIAQSFV--------DLMAFNAMGAPASFKFFETTIER
        ::  *   .  ::         :      .:::;   *;;  *;.* *;;;  .* *
Motif:  -A--N---*-----*--------*-------**--------L*-*---G*-A-F**---I-R
```

FIG. 2G

```
SM              KR-YTSTTEILNATLIHQSITGLYETRIDLNKLGGD        (SEQ ID NO:1)
SP              KR-YTSTKEVLDATLIHQSITGLYETRIDLSQLGGD        (SEQ ID NO:2)
ST              YRDYTPSSLLKDATLIHQSVTGLYETRIDLAKLGEG        (SEQ ID NO:3)
LI              KR-YNNLKELLNSTIIYQSITGLYESRKRLD----D        (SEQ ID NO:4)
                 * *.   . : ::*;*;**.*****.*    *      .
Motif:          -R-Y----*-**T*I*QS*TGLYE*R--L-------
```

FIG. 3A

Alignment of the N terminal RuvC-like Domains disclosed in Chylinski 2013 (excluding sequence outliers).
CLUSTAL format alignment by MAFFT (v7.058b).

| | | |
|---|---|---|
| 1,12 | DIGTNSVGWAVT | (SEQ ID NO:54) |
| 3,20 | DVGTNSVGWAVT | (SEQ ID NO:56) |
| 15 | DMGTNSVGWAVT | (SEQ ID NO:58) |
| 4 | DVGTSSVGWAVT | (SEQ ID NO:59) |
| 7 | DIGTASVGWAVT | (SEQ ID NO:60) |
| 6 | DVGTGSVGWAVT | (SEQ ID NO:61) |
| 9 | DIGTNSVGWAVV | (SEQ ID NO:62) |
| 10 | DIGTNSVGWAVI | (SEQ ID NO:63) |
| 11 | DIGTNSVGWAVL | (SEQ ID NO:64) |
| 42 | DLGTNSIGWAVV | (SEQ ID NO:65) |
| 48 | DLGTNSIGWAI- | (SEQ ID NO:66) |
| 43 | DLGTNSIGWALV | (SEQ ID NO:67) |
| 2 | DIGTNSVGWCVT | (SEQ ID NO:68) |
| 14 | DIGTNSVGYAVT | (SEQ ID NO:69) |
| 5 | DMGTGSLGWAVT | (SEQ ID NO:70) |
| 16 | DIGTSSVGWAAI | (SEQ ID NO:71) |
| 8 | DLGTGSVGWAVV | (SEQ ID NO:72) |
| 22 | DLGVGSVGWAIV | (SEQ ID NO:73) |
| 23 | DLGIASIGWAII | (SEQ ID NO:74) |
| 24 | DLGIASVGWAIV | (SEQ ID NO:75) |
| 25 | DLGVASVGWSIV | (SEQ ID NO:76) |
| 26 | DIGIASVGWAIL | (SEQ ID NO:77) |
| 28 | DLGISSVGWSVI | (SEQ ID NO:78) |
| 32 | DIGIASVGWSVI | (SEQ ID NO:79) |
| 33 | DVGIGSIGWAVI | (SEQ ID NO:80) |
| 39 | DLGVGSIGFAIV | (SEQ ID NO:81) |
| 34 | DIGYASIGWAVI | (SEQ ID NO:82) |
| 47 | DTGTNSLGWAIV | (SEQ ID NO:83) |
| 50 | DLGTNSIGWCLL | (SEQ ID NO:84) |
| 49 | DIGTDSLGWAVF | (SEQ ID NO:85) |
| 18 | DIGSNSIGFAVV | (SEQ ID NO:86) |
| 41 | DLGVGSIGVAVA | (SEQ ID NO:87) |
| 45 | DLGIASCGWGVV | (SEQ ID NO:88) |

FIG. 3B

| | | |
|---|---|---|
| 21 | DLGIASVGWCLT | (SEQ ID NO:89) |
| 27 | DIGIGSVGVGIL | (SEQ ID NO:90) |
| 29 | DIGITSVGYGLI | (SEQ ID NO:91) |
| 30 | DIGITSVGFGII | (SEQ ID NO:92) |
| 31 | DVGITSTGYAVL | (SEQ ID NO:93) |
| 40 | DLGITSFGYAIL | (SEQ ID NO:94) |
| 17 | DIGNASVGWSAF | (SEQ ID NO:95) |
| 19 | DVGTNSCGWVAM | (SEQ ID NO:96) |
| 35 | DVGERSIGLAAV | (SEQ ID NO:97) |
| 36 | DVGLNSVGLAAV | (SEQ ID NO:98) |
| 37 | DVGLMSVGLAAI | (SEQ ID NO:99) |
| 38 | DVGTFSVGLAAI | (SEQ ID NO:100) |
| 13 | DIGTGSVGYACM | (SEQ ID NO:101) |
| 44 | DLGTTSIGFAHI | (SEQ ID NO:102) |
| 46 | DLGTNSIGSSVR | (SEQ ID NO:103) |
| | * * * * | |

FIG. 4A

Alignment of the N terminal RuvC-like Domains disclosed in Chylinski 2013
(CLUSTAL format alignment by MAFFT (v7.058b))

```
1,12      D----IGTNSVGWAVT      (SEQ ID NO:54)
3,20      D----VGTNSVGWAVT      (SEQ ID NO:56)
15        D----MGTNSVGWAVT      (SEQ ID NO:58)
4         D----VGTSSVGWAVT      (SEQ ID NO:59)
7         D----IGTASVGWAVT      (SEQ ID NO:60)
6         D----VGTGSVGWAVT      (SEQ ID NO:61)
9         D----IGTNSVGWAVV      (SEQ ID NO:62)
10        D----IGTNSVGWAVI      (SEQ ID NO:63)
52        D----IGTNSIGWAVI      (SEQ ID NO:114)
11        D----IGTNSVGWAVL      (SEQ ID NO:64)
42        D----LGTNSIGWAVV      (SEQ ID NO:65)
48        D----LGTNSIGWAI-      (SEQ ID NO:66)
43        D----LGTNSIGWALV      (SEQ ID NO:67)
2         D----IGTNSVGWCVT      (SEQ ID NO:68)
14        D----IGTNSVGYAVT      (SEQ ID NO:69)
5         D----MGTGSLGWAVT      (SEQ ID NO:70)
16        D----IGTSSVGWAAI      (SEQ ID NO:71)
8         D----LGTGSVGWAVV      (SEQ ID NO:72)
22        D----LGVGSVGWAIV      (SEQ ID NO:73)
23        D----LGIASIGWAII      (SEQ ID NO:74)
24        D----LGIASVGWAIV      (SEQ ID NO:75)
68        D----LGIASVGWAVV      (SEQ ID NO:127)
25        D----LGVASVGWSIV      (SEQ ID NO:76)
26        D----IGIASVGWAIL      (SEQ ID NO:77)
66        D----IGIASVGWAVL      (SEQ ID NO:130)
59        D----IGIASIGWAVI      (SEQ ID NO:131)
61        D----IGIASVGWAII      (SEQ ID NO:132)
64        D----VGIASVGWAVI      (SEQ ID NO:133)
62        D----IGIASVGWAL-      (SEQ ID NO:134)
67        D----IGIASVGWAMV      (SEQ ID NO:135)
32        D----IGIASVGWSVI      (SEQ ID NO:79)
28        D----LGISSVGWSVI      (SEQ ID NO:78)
63        D----IGITSVGWAVI      (SEQ ID NO:138)
```

FIG. 4B

```
33      D-----VGIGSIGWAVI       (SEQ ID NO:79)
57      D-----LGISSLGWAIV       (SEQ ID NO:140)
39      D-----LGVGSIGFAIV       (SEQ ID NO:81)
34      D-----IGYASIGWAVI       (SEQ ID NO:82)
50      D-----LGTNSIGWCLL       (SEQ ID NO:84)
54      D-----LGTNSIGWGLL       (SEQ ID NO:144)
47      D-----TGTNSLGWAIV       (SEQ ID NO:83)
49      D-----IGTDSLGWAVF       (SEQ ID NO:85)
51      D-----LGSTSLGWAIF       (SEQ ID NO:147)
58      D-----IGISSIGWAFS       (SEQ ID NO:148)
21      D-----LGIASVGWCLT       (SEQ ID NO:89)
45      D-----LGIASCGWGVV       (SEQ ID NO:88)
18      D-----IGSNSIGFAVV       (SEQ ID NO:85)
65      D-----IGTTSIGFSVI       (SEQ ID NO:152)
29      D-----IGITSVGYGLI       (SEQ ID NO:91)
30      D-----IGITSVGFGII       (SEQ ID NO:92)
44      D-----LGTTSIGFAHI       (SEQ ID NO:102)
27      D-----IGIGSVGVGIL       (SEQ ID NO:90)
41      D-----LGVGSIGVAVA       (SEQ ID NO:87)
31      D-----VGITSTGYAVL       (SEQ ID NO:93)
40      D-----LGITSFGYAIL       (SEQ ID NO:94)
53      D-----IGTSSIGWWLY       (SEQ ID NO:160)
55      D-----LGSNSLGWFVT       (SEQ ID NO:161)
56      D-----LGANSLGWFVV       (SEQ ID NO:162)
17      D-----IGNASVGWSAF       (SEQ ID NO:95)
19      D-----VGTNSCGWVAM       (SEQ ID NO:96)
35      D-----VGERSIGLAAV       (SEQ ID NO:97)
36      D-----VGLNSVGLAAV       (SEQ ID NO:98)
37      D-----VGLMSVGLAAI       (SEQ ID NO:99)
38      D-----VGTFSVGLAAI       (SEQ ID NO:100)
13      D-----IGTGSVGYACM       (SEQ ID NO:101)
46      D-----LGTNSIGSSVR       (SEQ ID NO:103)
60      DIGLRIGITSCGWSI-        (SEQ ID NO:171)
69      D-----MGAKYTGVFYA       (SEQ ID NO:172)
73      D-----LGGKNTGFFSF       (SEQ ID NO:173)
74      D-----LGVKNTGVFSA       (SEQ ID NO:174)
70      D-----LGAKFTGVALY       (SEQ ID NO:175)
71      D-----LGGKFTGVCLS       (SEQ ID NO:176)
72      D-----LGGTYTGTFIT       (SEQ ID NO:177)
              *    *   *
```

FIG. 5A

Alignment of the HNH-like Domains disclosed in Chylinski 2013
(CLUSTAL format alignment by MAFFT (v7.058b))

```
1      YDIDHIYPRS-LTKD------DSF-DNLVLCERTAN    (SEQ ID NO:178)
2      -DIDHIYPRSKVIKD------DSF-DNLVLVLKNEN    (SEQ ID NO:179)
3      -DRDHIYPQS-KIKD------DSI-DNLVLVNKTYN    (SEQ ID NO:180)
4      -DIDHIYPRS-KIKD------DSI-TNRVLVEKDIN    (SEQ ID NO:181)
6      -DIDHIYPQS-KIKD------DSI-SNRVLVCSSCN    (SEQ ID NO:182)
5      -DIDHIYPQS-KTMD------DSL-NNRVLVKKNYN    (SEQ ID NO:183)
7      -DQDHIYPKS-KIYD------DSL-ENRVLVKKNLN    (SEQ ID NO:184)
8      -QIDHIVPQS-LVKD------DSF-DNRVLVVPSEN    (SEQ ID NO:185)
9      -DIDHIIPQA-FIKD------NSI-DNRVLTSSKEN    (SEQ ID NO:186)
12     -DIDHIIPQA-FLKD------NSI-DNKVLVSSASN    (SEQ ID NO:187)
16     -DIDHIIPQA-YTKD------NSL-DNRVLVSNITN    (SEQ ID NO:188)
11     -DIDHIVPQS-FITD------NSI-DNLVLTSSAGN    (SEQ ID NO:189)
10     -DVDHIVPQS-FLKD------DSI-DNKVLTRSDKN    (SEQ ID NO:190)
14     -NIDHIYPQS-MVKD------DSL-DNKVLVQSEIN    (SEQ ID NO:191)
18     -DIDHILPQS-LIKD------DSL-DNRVLVNATIN    (SEQ ID NO:192)
19     -DIDHILPQS-FIKD------DSL-ENRVLVKKAVN    (SEQ ID NO:193)
13     -EVDHIFPRS-FIKD------DSI-DNKVLVIKKMN    (SEQ ID NO:194)
15     -EVDHIIPRS-YIKD------DSF-ENKVLVYREEN    (SEQ ID NO:195)
17     -DIDHIIPQA-VTQN------DSI-DNRVLVARAEN    (SEQ ID NO:196)
22     -EIDHIIPYS-ISFD------DSS-SNKLLVLAESN    (SEQ ID NO:197)
24     -EIDHIIPYS-LCFD------DSS-ANKVLVHKQSN    (SEQ ID NO:198)
32     -DIDHIIPYS-RSMD------DSY-SNKVLVLSGEN    (SEQ ID NO:199)
63     -DIDHIIPYS-KSMD------DSF-NNKVLCLAEEN    (SEQ ID NO:200)
59     -EIDHIYPYS-RSFD------DSY-MNKVLVFTKQN    (SEQ ID NO:201)
65     -QIDHIYPYS-RSMD------DSY-MNKVLVLTDEN    (SEQ ID NO:202)
64     -EIDHIIPFS-RSFD------DSL-SNKILVLGSEN    (SEQ ID NO:203)
68     -EIDHALPFS-RTWD------DSF-NNKVLVLGSEN    (SEQ ID NO:204)
69     -EIDHALPFS-RTWD------DSF-NNKVLVLASEN    (SEQ ID NO:205)
28     -EIDHIIPIS-ISLD------DSI-NNKVLVLSKAN    (SEQ ID NO:206)
30     -EVDHIIPIS-ISLD------DSI-TNKVLVTHREN    (SEQ ID NO:207)
62     -QVDHALPYS-RSYD------DSK-NNKVLVLTHEN    (SEQ ID NO:208)
27     -EVDHILPLS-ITFD------DSL-ANKVLVYATAN    (SEQ ID NO:209)
26     -EIDHIIPRS-ISFD------DAR-SNKVLVYRSEN    (SEQ ID NO:210)
```

FIG. 5B

```
29      -EVDHIIPRS-VSFD------NSY-HNKVLVKQSEN       (SEQ ID NO:211)
67      -DIDHILPYS-ITFD------DSF-RNKVLVTSQEN       (SEQ ID NO:212)
58      -EIDHILPRS-RSAD------DSF-ANKVLCLARAN       (SEQ ID NO:213)
51      -EIEHLLPFS-LTLD------DSM-ANKTVCFRQAN       (SEQ ID NO:214)
55      -DIDHILPFS-VSLD------DSA-ANKVVCLREAN       (SEQ ID NO:215)
57      -DIDHLIPFS-ISWD------DSA-ANKVVCMRYAN       (SEQ ID NO:216)
56      -DIDHILPVA-MTLD------DSP-ANKIICMRYAN       (SEQ ID NO:217)
54      -DVDHILPYS-RTLD------DSF-PNRTLCLREAN       (SEQ ID NO:218)
52      -EIEHILPFS-RTLD------DSL-NNRTVAMRRAN       (SEQ ID NO:219)
31      -EVDHIIPYS-ISWD------DSY-TNKVLTSAKCN       (SEQ ID NO:220)
45      -QVDHILPWS-RFGD------DSY-LNKTLCTARSN       (SEQ ID NO:221)
53      -QVDHILPFS-KTLD------DSF-ANKVLAQHDAN       (SEQ ID NO:222)
60      -QIDHAFPLS-RSLD------DSQ-SNKVLCLTSSN       (SEQ ID NO:223)
21      -DIDHIVPRS-ISFD------DSF-SNLVIVNKLDN       (SEQ ID NO:224)
23      -EIEHIIPYS-MSYD------NSQ-ANKILTEKAEN       (SEQ ID NO:225)
25      -EIDHVIPYS-KSAD------DSW-FNKLLVKKSTN       (SEQ ID NO:226)
49      -EMDHILPYS-RSLD------NGW-HNRVLVHGKDN       (SEQ ID NO:227)
33      -EVDHIVPYS-LILD------NTI-NNKALVYAEEN       (SEQ ID NO:228)
42      -EIEHVIPQS-LYFD------DSF-SNKVICEAEVN       (SEQ ID NO:229)
43      -DIEHIIPQA-RLFD------DSF-SNKTLEARSVN       (SEQ ID NO:230)
44      -EIEHIVPKA-RVFD------DSF-SNKTLTFHRIN       (SEQ ID NO:231)
20      -DKDHIIPQS-MKKD------DSIINNLVLVNKNAN       (SEQ ID NO:232)
66      -EVEHIWPRS-RSFD------NSP-RNKTLCRKDVN       (SEQ ID NO:233)
61      -IVNHIIPYN-RSFD------DTY-HNRVLTLTETK       (SEQ ID NO:234)
46      -DMEHTIPKS-ISFD------NSD-QNLTLCESYYN       (SEQ ID NO:235)
47      -DIEHTIPRS-AGGD------STK-MNLTLCSSRFN       (SEQ ID NO:236)
48      -DIEHTIPRS-ISQD------NSQ-MNKTLCSLKFN       (SEQ ID NO:237)
50      -DIDHVIPLA-RGGR------DSL-DNMVLCQSDAN       (SEQ ID NO:238)
39      -DIEHLFPIA-ESED------NGR-NNLVISHSACN       (SEQ ID NO:239)
41      -DVDHIFPRD-DTAD------NSY-GNKVVAHRQCN       (SEQ ID NO:240)
40      -DIEHIVPQS-LGGL------STD-YNTIVTLKSVN       (SEQ ID NO:241)
35      -ELDHIVPRT-DGGS------NRH-ENLAITCGACN       (SEQ ID NO:242)
36      -EMDHIVPRKGVGST------NTR-TNFAAVCAECN       (SEQ ID NO:243)
37      -EMDHIVPRKGVGST------NTR-VNLAAACAACN       (SEQ ID NO:244)
38      -EMDHIVPRAGQGST------NTR-ENLVAVCHRCN       (SEQ ID NO:245)
70      -EIDHILPRS-LIKDARGIVFNAE-PNLIYASSRGN       (SEQ ID NO:246)
71      -EIDHIIPRS-LTGRTKKTVFNSE-ANLIYCSSKGN       (SEQ ID NO:247)
73      -EIDHIIPRS-LTLKKSESIYNSE-VNLIFVSAQGN       (SEQ ID NO:248)
```

FIG. 5C

```
72      -EIDHIYPRS-LSKKHFGVIFNSE-VNLIYCSSQGN       (SEQ ID NO:249)
74      -EIDHILPRS-HTLKIYGTVFNPE-GNLIYVHQKCN       (SEQ ID NO:250)
75      -ELDHIIPRS-HKKY---GTLNDE-ANLICVTRGDN       (SEQ ID NO:251)
34      -ELEHIVPHS-FRQS------NAL-SSLVLTWPGVN       (SEQ ID NO:252)
           :*   *                  .   .      :
```

FIG. 6A

Alignment of the HNH-like Domains disclosed in Chylinski 2013 (excluding sequence outliers). CLUSTAL format alignment by MAFFT (v7.058b).

```
1     YDIDHIYPRS-LTKDDS-FDNLVLCERTAN    (SEQ ID NO:178)
2     -DIDHIYPRSKVIKDDS-FDNLVLVLKNEN    (SEQ ID NO:179)
3     -DRDHIYPQS-KIKDDS-IDNLVLVNKTYN    (SEQ ID NO:180)
4     -DIDHIYPRS-KIKDDS-ITNRVLVEKDIN    (SEQ ID NO:181)
6     -DIDHIYPQS-KIKDDS-ISNRVLVCSSCN    (SEQ ID NO:182)
5     -DIDHIYPQS-KTMDDS-LNNRVLVKKNYN    (SEQ ID NO:183)
7     -DQDHIYPKS-KIYDDS-LENRVLVKKNLN    (SEQ ID NO:184)
8     -QIDHIVPQS-LVKDDS-FDNRVLVVPSEN    (SEQ ID NO:185)
9     -DIDHIIPQA-FIKDNS-IDNRVLTSSKEN    (SEQ ID NO:186)
12    -DIDHIIPQA-FLKDNS-IDNKVLVSSASN    (SEQ ID NO:187)
16    -DIDHIIPQA-YTKDNS-LDNRVLVSNITN    (SEQ ID NO:188)
11    -DIDHIVPQS-FITDNS-IDNLVLTSSAGN    (SEQ ID NO:189)
10    -DVDHIVPQS-FLKDDS-IDNKVLTRSDKN    (SEQ ID NO:190)
14    -NIDHIYPQS-MVKDDS-LDNKVLVQSEIN    (SEQ ID NO:191)
18    -DIDHILPQS-LIKDDS-LDNRVLVNATIN    (SEQ ID NO:192)
19    -DIDHILPQS-FIKDDS-LENRVLVKKAVN    (SEQ ID NO:193)
13    -EVDHIFPRS-FIKDDS-IDNKVLVIKKMN    (SEQ ID NO:194)
15    -EVDHIIPRS-YIKDDS-FENKVLVYREEN    (SEQ ID NO:195)
17    -DIDHIIPQA-VTQNDS-IDNRVLVARAEN    (SEQ ID NO:196)
21    -DIDHIVPRS-ISFDDS-FSNLVIVNKLDN    (SEQ ID NO:224)
22    -EIDHIIPYS-ISFDDS-SSNKLLVLAESN    (SEQ ID NO:197)
24    -EIDHIIPYS-LCFDDS-SANKVLVHKQSN    (SEQ ID NO:198)
28    -EIDHIIPIS-ISLDDS-INNKVLVLSKAN    (SEQ ID NO:206)
30    -EVDHIIPIS-ISLDDS-ITNKVLVTHREN    (SEQ ID NO:207)
27    -EVDHILPLS-ITFDDS-LANKVLVYATAN    (SEQ ID NO:209)
26    -EIDHIIPRS-ISFDDA-RSNKVLVYRSEN    (SEQ ID NO:210)
29    -EVDHIIPRS-VSFDNS-YHNKVLVKQSEN    (SEQ ID NO:211)
31    -EVDHIIPYS-ISWDDS-YTNKVLTSAKCN    (SEQ ID NO:220)
32    -DIDHIIPYS-RSMDDS-YSNKVLVLSGEN    (SEQ ID NO:199)
23    -EIEHIIPYS-MSYDNS-QANKILTEKAEN    (SEQ ID NO:225)
33    -EVDHIVPYS-LILDNT-INNKALVYAEEN    (SEQ ID NO:228)
25    -EIDHVIPYS-KSADDS-WFNKLLVKKSTN    (SEQ ID NO:226)
49    -EMDHILPYS-RSLDNG-WHNRVLVHGKDN    (SEQ ID NO:227)
42    -EIEHVIPQS-LYFDDS-FSNKVICEAEVN    (SEQ ID NO:229)
43    -DIEHIIPQA-RLFDDS-FSNKTLEARSVN    (SEQ ID NO:230)
```

FIG. 6B

```
44      -EIEHIVPKA-RVFDDS-FSNKTLTFHRIN        (SEQ ID NO:231)
20      -DKDHIIPQS-MKKDDSIINNLVLVNKNAN        (SEQ ID NO:232)
45      -QVDHILPWS-RFGDDS-YLNKTLCTARSN        (SEQ ID NO:221)
50      -DIDHVIPLA-RGGRDS-LDNMVLCQSDAN        (SEQ ID NO:238)
46      -DMEHTIPKS-ISFDNS-DQNLTLCESYYN        (SEQ ID NO:235)
47      -DIEHTIPRS-AGGDST-KMNLTLCSSRFN        (SEQ ID NO:236)
48      -DIEHTIPRS-ISQDNS-QMNKTLCSLKFN        (SEQ ID NO:237)
39      -DIEHLFPIA-ESEDNG-RNNLVISHSACN        (SEQ ID NO:239)
41      -DVDHIFPRD-DTADNS-YGNKVVAHRQCN        (SEQ ID NO:240)
40      -DIEHIVPQS-LGGLST-DYNTIVTLKSVN        (SEQ ID NO:241)
35      -ELDHIVPRT-DGGSNR-HENLAITCGACN        (SEQ ID NO:242)
36      -EMDHIVPRKGVGSTNT-RTNFAAVCAECN        (SEQ ID NO:243)
37      -EMDHIVPRKGVGSTNT-RVNLAAACAACN        (SEQ ID NO:244)
38      -EMDHIVPRAGQGSTNT-RENLVAVCHRCN        (SEQ ID NO:245)
34      -ELEHIVPHS-FRQSNA-LSSLVLTWPGVN        (SEQ ID NO:252)
```

FIG. 7A

Sequence alignment between SpCas9 and NmCas9

```
NmCas9    MAAFKPNSINYILGLDIGIASVGWAMVEIDEEENPIRLID------------LGVRVFE
SpCas9    ------MDKKYSIGLDIGTNSVGWAVITDEYKVPSKKFKVLGNTDRHSIKKNLIGALLFD
          ----------*Y-*GLDIG--SVGWA**-*-*-----**----------------*G--*F*

NmCas9    RAEVPKTGDSLAMARRLARSVRRLTKRRAHRLLRTRRLLKREGVLQAA------------
SpCas9    SGET-------AEATRLKRTARRRYTRRKNRICYLQEIFSNEMAKVDDSFFHRLEESFLV
          --E---------A-A-RL-R*-RR---RR--R*----*-**--E---------------

NmCas9    -----------NFDENGLIKSLPNTPWQLRAAALDRK---LTPLEWSAVLLHLIKHR
SpCas9    EEDKKHERHPIFGNIVDEVAYHEKYP-TIYHLRKKLVDSTDKADLRLI-YLALAHMIKFR
          ----------------DE----*--P-T **LR---*D--------L------L-H*IK-R

NmCas9    GYLSQRKNE---------------------------GETA----------DKEL---
SpCas9    GHFLIEGDLNPDNSDVDKLFIQLVQTYNQLFEENPINASGVDAKAILSARLSKSRRLENL
          G**---*---------------------------G--A--------*-L---

NmCas9    ----GALLKGVAGNAHALQTG---DFRTPAE------LAL--NKFEKESGHIRNQ-RSD
SpCas9    IAQLPGEKKNGLFGNLIALSLGLTPNFKSNFDLAEDAKLQLSKDTYDDDLDNLLAQIGDQ
          -----G---*G*-GN--AL--G---*F**--*-------L-L--*-***-*----Q---*

NmCas9    YSHTFSR----------------------------------KDLQA
SpCas9    YADLFLAAKNLSDAILLSDILRVNTEITKAPLSASMIKRYDEHHQDLTLLKALVRQQLPE
          Y*---F-----------------------------------**L--

NmCas9    ELILLFEKQKEFGN-PHVSGGLK--------------EGIETL--------LMTQRPA
SpCas9    KYKEIFFDQSKNGYAGYIDGGASQEEFYKFIKPILEKMDGTEELLVKLNREDLLRKQRTF
          *----F---Q-*-G----**--GG-----------*G-E-L----------L--QR--

NmCas9    LSGDAV-QKMLGH--------CTFEPAEP-----------KAAKNTYTAERFIWL
SpCas9    DNGSIPHQIHLGELHAILRRQEDFYPFLKDNREKIEKILTFRIPYYVGPLARGNSRFAWM
          --G----Q--LG----------F-P------------------*----RF-W*

NmCas9    TKLNNLRILEQGSERPLTD------TERATLMDEPY------RKSKLTYAQAR------
SpCas9    TRKSEETITPWNFEEVVDKGASAQSFIERMTNFDKNLPNEKVLPKHSLLYEYFTVYNELT
          T*-*-**--I-----E--*----------ER-T-*D*--------K--L-Y--------

NmCas9    ----KLLGLEDTAFFKGLRY--------GKDN----------------AEA
SpCas9    KVKYVTEGMRKPAFLSGEQKKAIVDLLFKTNRKVTVKQLKEDYFKKIECFDSVEISGVED
          -------G*----AF*-G-*----------*-------------------E-

NmCas9    STLMEMKAYHAISRALEKEGLKDKKSPLNLSPELQDEIGTAFSLFKTDEDITGRLKDRIQ
SpCas9    RFNASLGTYHDLLKIIKDKDFLDNEE----NEDILEDIVLTLTLFEDREMIEERLKTYAH
          ----*-*YH-*-*-*-*-*-D**----------**-**I-***LF*--E-I--RLK---*

NmCas9    P--EILEALLKHISFDKPVQISLKALRRIVPLMEQGKRYDEACAE----IYGDHYGKKNT
SpCas9    LFDDKVMKQLKRRRYTGWGRLSRKLI--------NGIRDKQSGKTILDFLKSDGFANRNF
          ----*-*---LK*--*-*--**S--K-*--------*G-R--**--------*--D-*-**N-

NmCas9    EEKI------Y------------LPPIPADEIRNPVVLRALSQARKVINGVVRRYG-
SpCas9    MQLIHDDSLTFKEDIQKAQVSGQGDSLHEHIANLAGSPAIKKGILQTVKVVDELVKVMGR
          -*-I-*------------------L----A*----P-*-*-*-Q*--KV**-*V*--G-

NmCas9    -SPARIHIETAREVGKSPKDPKEIEKRQEENRKDREKAAAKFREYFPNF----VGEFKSK
SpCas9    HKPENIVIEMAREQTTQKGQKNSRER------MKRIEEGIKELGSQILKEHPVENTQL
          --P--I-IE-ARE-------*-K-*K---*-R---------**---**E---**------E-

NmCas9    DILKRLYEQQHGKCLYSGKEINLGRLNEKGYVEIDRALPFSRTWDDSFNNKVLVLGSEN
SpCas9    QNEKLYLYYLQNGRDMYVDQELDINRLSD---VDHIVPQSFLKDDSIDNKVLTRSDKN
          *---KL-LY--Q-G*--*Y--E*** EL-*-*--**DH-*-P-S---DDS**NKVL----*N

NmCas9    QNKGNQTPYEYFNGKDNSREWQEFKA-RVET-SRFF-RSKKQRILLQKFDEDGFKERNLN
SpCas9    RGKSDNVPSEEVVKKM-KNYWRQLLNAKLITQRKFDNLTKAERGGLSELDKAGFIKRQLV
          * K--P-E----K------W*--T--*F----K-*R--L-**D-GF-*R*L-
```

FIG. 7B

```
NmCas9    DTRYVSRFLCQFVADRMRLTGKGKKRVP------ASNGQITNLLRGFWGLRKVRAENDRH
SpCas9    ETRQITKHVAQILDSRMNTKYDENDKLIREVKVITLKSKLVSDFRKDFQFYKVREINNYH
          *TR-*-*-*-Q**--RM--------*-***------*-*-**--*-R--*-*--KVR--N*-H

NmCas9    HALDAVVVACSTVAMQQKI---TRFVRYKEMNAFDGKTID----KETGEVLHQKTHFPQP
SpCas9   BHAHDAYLNAVVGTALIKKYPKLESEPVYGDYKVYDVRKMIAKSEQEIGKATAKYFFYSNI
          HH-AD-*-A----A-*-K---------Y-*-*-*D-*-*-------*E-G*----*----*--

NmCas9    WEFFAQEVMIRVFGKPDGKPE-----------FEEADTLEKLRTLLAEKLSSKPEAVHEY
SpCas9    MNFFKTEITLA-NGEIRKRPLIETNGETGEIVWDKGRDFATVRKVLS-----MPQ-----
          --*FF--E*-*----G*----P-----------***----*--*R-*L*------P*-----

NmCas9    VTPLFVSRAPNRKMSGQGHMETVKSAKRLDEGVSVLRVPLTQLKLEDLEKMVN--REREP
SpCas9    ----------------------VNIVKKTEVQTGGFSKES----ILPKRNSDKLIARKKDWDP
          -----------------------VK------G-S---------L---**-*K-----*P

NmCas9    KLYEALKARLEAHKDDPAKAFAEPFYKYDKAGNRTQQVKAVR---VEQVQKTGVRVRNH-
SpCas9    KKYGGFD--------SPTVAYSVLVVAKVEKGK-SKKLKSVKELLGITIMERSSFEKNPI
          K-Y--*---------P*-A**--------*-G*-****K*V*------*-*----*-*N--

NmCas9    -----NGIAD-----------------NATMVRVDVFEKGDKYYLVPIY-------
SpCas9    DFLEAKGYKEVKKDLIIKLPKYSLFELENGRKRMLASAGELQKGNELALPSKYVNFLYLA
          -----*G--*--------------------*--*------KG--L---Y-------

NmCas9    -SWQVAKGILPDRAVVQGKDEEDWQLIDDS------FNFKFSLHPNDLVEVI--------
SpCas9    SHYEKLKGSPEDNEQKQLFVEQHKHYLDEIIEQISEFSKRVILADANLDKVLSAYNKHRD
          --**--KG---D----Q---E-*-*-D*--------F---*-L-----*L-*V*--------

NmCas9    ------------------TKKARMFGYFASCHRGTGNINIRIHDLDHKIGKNGILESIGV
SpCas9    KPIREQAENIIHLFTLTNLGAPAAFKYFDTTIDRKRYTS-TKEVLDATLIHQSI------
          ------------------F--YF-*---------------LD--*-**-I------

NmCas9    KTALSPQKYQIDELGKEIRPCRLKKRPPVR    (SEQ ID NO:6)
SpCas9    -TGLYETRIDLSQLGGD-------------   (SEQ ID NO:7)
          -T-L---*-**-*LG-*-------------
```

Percent Identity Matrix - created by Clustal2.1

FIG. 8

Sequence of the NmCas9 ORF with dual NLS and HA tags

[R]

atggtgcctaagaagaagagaaaggtggctgccttcaaacctaattcaatcaactacatcctcggcctcgat
atcggcatcgcatccgtcggctgggcgatggtagaaattgacgaagaagaaaaccccatccgcctgattgat
ttgggcgtgcgcgtatttgagcgtgccgaagtaccgaaaacaggcgactcccttgccatggcaaggcgtttg
gcgcgcagtgttcgccgcctgaccgccgtcgcgcccaccgcctgcttcggaccgccgcctattgaaacgc
gaaggcgtattacaagccgccaattttgacgaaaacggcttgattaaatccttaccgaatacaccatggcaa
cttcgcgcagccgcattagaccgcaaactgacgcctttagagtggtcggcagtcttgttgcatttaatcaaa
catcgcggctatttatcgcaacggaaaaacgagggcgaaactgccgataaggagcttggcgctttgcttaaa
ggcgtagccggcaatgcccatgccttacagacaggcgatttccgcacaccggccgaattggctttaaataaa
tttgagaaagaaagcggccatatccgcaatcagcgcagcgattattcgcatacgttcagccgcaaagattta
caggcggagctgattttgctgtttgaaaaacaaaaagaatttggcaatccgcatgtttcaggcggccttaaa
gaaggtattgaaaccctactgatgacgcaacgccctgccctgtccggcgatgccgttcaaaaaatgttgggg
cattgcaccttcgaaccggcagagccgaaagccgctaaaaacacctacacagccgaacgtttcatctggctg
accaagctgaacaacctgcgtattttagagcaaggcagcgagcggccattgaccgataccgaacgcgccacg
cttatggacgagccatacagaaaatccaaactgacttacgcacaagcccgtaagctgctggctttagaagat
accgccttttcaaaggcttgcgctatggtaaagacaatgccgaagcctcaacattgatggaaatgaaggcc
taccatgccatcagccgtgcactggaaaagaaggattgaaagacaaaaaatccccattaaacctttctccc
gaattacaagacgaaatcggcacggcattctccctgttcaaaaccgatgaagacattacaggccgtctgaaa
gaccgtatacagcccgaaatcttagaagcgctgttgaaacacatcagcttcgataagttcgtccaaatttcc
ttgaaagcattgcgccgaattgtgcctctaatggaacaaggcaaacgttacgatgaagcctgcgccgaaatc
tacggagaccattacggcaagaagaatacggaagaaaagatttatctgccgccgattccgccgacgaaatc
cgcaaccccgtcgtcttgcgcgccttatctcaagcacgtaaggtcattaacggcgtggtacgccgttacggc
tccccagctcgtatccatattgaaactgcaagggaagtaggtaaatcgtttaaagaccgcaaagaaattgag
aaacgccaagaagaaaacgcaaagaccgggaaaaagccgccgccaaattccgagagtatttccccaattttt
gtcggagaacccaaatccaaagatattctgaaactgcgcctgtacgagcaacaacacggcaaatgcctgtat
tcgggcaaagaaatcaacttaggccgtctgaacgaaaaaggctatgtcgaaatcgaccatgccctgccgttc
tcgcgcacatgggacgacagtttcaacaataaagtactggtattgggcagcgaaaaccaaaacaaaggcaat
caaacccccttacgaatacttcaacggcaaagacaacagccgcgaatggcaggaattaaagcgcgtgtcgaa
accagccgtttcccgcgcagtaaaaaacaacggattctgctgcaaaaattcgatgaagacggctttaaagaa
cgcaatctgaacgacacgcgctacgtcaaccgtttcctgtgtcaatttgttgccgaccgtatgcggctgaca
ggtaaaggcaagaaacgtgtctttgcatccaacggacaaattaccaatctgttgcgcggcttttggggattg
cgcaaagtgcgtgcggaaaacgaccgccatcacgccttggacgccgtcgtcgttgctgctcgaccgttgcc
atgcagcagaaaattacccgttttgtacgctataaagagatgaacgcgtttgacggtaaaaccatagacaaa
gaaacaggagaagtgctgcatcaaaaaacacacttcccacaaccttgggaattttcgcacaagaagtcatg
attcgcgtcttcggcaaaccggacggcaaacccgaattcgaagaagccgatacccctagaaaaactgcgcacg
ttgcttgccgaaaaattatcatctcgcccgaagccgtacacgaatacgttacgccactgtttgtttcacgc
gcgcccaatcggaagatgagcgggcaagggcatatggagaccgtcaaatccgccaaacgactggacgaaggc
gtcagcgtgttgcgcgtaccgctgacacagttaaaactgaaagacttggaaaaatggtcaatcgggagcgc
gaacctaagctatacgaagcactgaaagcacggctggaagcacataaagacgatcctgccaaagcctttgcc
gagccgttttacaaatacgataaagcaggcaaccgcacccaacaggtaaaagccgtacgcgtagagcaagta
cagaaaacggcgtatgggtgcgcaaccataacggtattgccgacaacgcaaccatggtgcgcgtagatgtg
tttgagaaaggcgacaagtattatctggtaccgatttacagttggcaggtagcgaaagggattttgccggat
agggctgttgtacaagaaaagatgaagaagattggcaacttattgatgatagtttcaactttaaattctca
ttacaccctaatgatttagtcgaggttataacaaaaaaagctagaatgtttggttactttgccagctgccat
cgaggcacaggtaatatcaatatacgcattcatgatcttgatcataaaattggcaaaaatggaatactggaa
ggtatcggcgtcaaaaccgccctttcattccaaaaataccaaattgacgaactgggcaaagaaatcagacca
tgccgtctgaaaaaacgcccgcctgtccgttaccatacgatgttccagattacgctgcagctccagcagcg
aagaaaagaagctggattaa

[G] (SEQ ID NO:303)

[O]

R: SV40 NLS, G: HA tag, O: synthetic NLS (1); all else NmCas9

```
cgggcgtcggacgaccttttggtcgcccggcctcagtgagcgagcgagcgcgcagagagggagtggccaa
gcccgcagcccgctggaaaccagcgggccggagtcactcgctcgctcgcgcgtctctccctcaccggtt
```

Right ITR 5,140   5,150   5,160   5,170   5,180   5,190   5,200

COMPOSITIONS AND METHODS FOR TREATING CEP290-ASSOCIATED DISEASE

CROSS-REFERENCE TO RELATED APPLICATIONS

The present application is a continuation-in-part of U.S. patent application Ser. No. 14/644,181, filed Mar. 10, 2015, and issued as U.S. Pat. No. 9,938,521, issued on Apr. 10, 2018, and claims the benefit of U.S. Provisional Appl. No. 61/950,733, filed Mar. 10, 2014; U.S. Provisional Appl. No. 62/036,576, filed Aug. 12, 2014; U.S. Provisional Appl. No. 62/370,202, filed Aug. 2, 2016; U.S. Provisional Appl. No. 62/400,526, filed Sep. 27, 2016; U.S. Provisional Appl. No. 62/443,568, filed Jan. 6, 2017; U.S. Provisional Appl. No. 62/503,800, filed May 9, 2017; and U.S. Provisional Appl. No. 62/535,193, filed Jul. 20, 2017;

the contents of which are hereby incorporated by reference in their entirety.

SEQUENCE LISTING

The instant application contains a Sequence Listing which has been submitted electronically in ASCII format and is hereby incorporated by reference in its entirety. Said ASCII copy, created on Aug. 2, 2017, is named SequenceListing.txt and is 1,440,000 bytes in size.

FIELD OF THE INVENTION

The invention relates to CRISPR/CAS-related methods and components for editing of a target nucleic acid sequence, and applications thereof in connection with Leber's Congenital Amaurosis 10 (LCA10).

BACKGROUND

Leber's congenital amaurosis (LCA) is the most severe form of inherited retinal dystrophy, with an onset of disease symptoms in the first years of life (Leber 1869) and an estimated prevalence of approximately 1 in 50,000 worldwide (Koenekoop 2007; Stone 2007). Genetically, LCA is a heterogeneous disease. To date, fifteen genes have been identified with mutations that result in LCA (den Hollander 2008; Estrada-Cuzcano 2011). The CEP290 gene is the most frequently mutated LCA gene accounting for approximately 15% of all cases (Stone 2007; den Hollander 2008; den Hollander 2006; Perrault 2007). Severe mutations in CEP290 have also been reported to cause systemic diseases that are characterized by brain defects, kidney malformations, polydactyly and/or obesity (Baal 2007; den Hollander 2008; Helou 2007; Valente 2006). Mutations of CEP290 are observed in several diseases, including Senior-Loken syndrome, Meckel Gruber syndrome, Bardet-Biedle syndrome, Joubert Syndrome, and Leber Congenital Amaurosis 10 (LCA10). Patients with LCA and early-onset retinal dystrophy often carry hypomorphic CEP290 alleles (Stone 2007; den Hollander 2006; Perrault 2007; Coppieters 2010; Littink 2010).

LCA, and other retinal dystrophies such as Retinitis Pigmentosa (RP), have long been considered incurable diseases. However, the first phase I/II clinical trials using gene augmentation therapy have led to promising results in a selected group of adult LCA/RP patients with mutations in the RPE65 gene (Bainbridge 2008; Cideciyan 2008; Hauswirth 2008; Maguire 2008). Unilateral subretinal injections of adeno-associated virus particles carrying constructs encoding the wild-type RPE65 cDNA were shown to be safe and moderately effective in some patients, without causing any adverse effects. In a follow-up study including adults and children, visual improvements were more sustained, especially in the children all of whom gained ambulatory vision (Maguire 2009). Although these studies demonstrated the potential to treat LCA using gene augmentation therapy and increased the development of therapeutic strategies for other genetic subtypes of retinal dystrophies (den Hollander 2010), it is hard to control the expression levels of the therapeutic genes when using gene augmentation therapy.

LCA10, one type of LCA, is an inherited (autosomal recessive) retinal degenerative disease characterized by severe loss of vision at birth. All subjects having LCA10 have had at least one c.2991+1655A to G (adenine to guanine) mutation in the CEP290 gene. Heterozygous nonsense, frameshift, and splice-site mutations have been identified on the remaining allele. A c.2991+1655A to G mutation in the CEP290 gene give rise to a cryptic splice donor cite in intron 26 which results in the inclusion of an aberrant exon of 128 bp in the mutant CEP290 mRNA, and inserts a premature stop codon (P.C998X). The sequence of the cryptic exon contains part of an Alu repeat.

There are currently no approved therapeutics for LCA10. Despite advances that have been made using gene therapy, there remains a need for therapeutics to treat retinal dystrophies, including LCA10.

SUMMARY OF THE INVENTION

The inventors have addressed a key unmet need in the field by providing new and effective means of delivering genome editing systems to the affected tissues of subjects suffering from CEP290 associated diseases and other inherited retinal dystrophies. This disclosure provides nucleic acids and vectors for efficient transduction of genome editing systems in retinal cells and cells in other tissues, as well as methods of using these vectors to treat subjects. These nucleic acids, vectors and methods represent an important step forward in the development of treatments for CEP290 associated diseases.

In one aspect, the disclosure relates to a method for treating or altering a cell in a subject (e.g., a human subject or an animal subject), that includes administering to the subject a nucleic acid encoding a Cas9 and first and second guide RNAs (gRNAs) targeted to the CEP290 gene of the subject. In certain embodiments, the first and second gRNAs are targeted to one or more target sequences that encompass or are proximal to a CEP290 target position. The first gRNA may include a targeting domain selected from SEQ ID NOs: 389-391 (corresponding RNA sequences in SEQ ID NOs: 530, 468, and 538, respectively), while the second gRNA may include a targeting domain selected from SEQ ID NOs: 388, 392, and 394 (corresponding RNA sequences in SEQ ID NOs: 558, 460, 568, respectively). The Cas9, which may be a modified Cas9 (e.g., a Cas9 engineered to alter PAM specificity, improve fidelity, or to alter or improve another structural or functional aspect of the Cas9), may include one or more of a nuclear localization signal (NLS) and/or a polyadenylation signal. Certain embodiments are characterized by Cas9s that include both a C-terminal and an N-terminal NLS. The Cas9 is encoded, in certain embodiments, by SEQ ID NO: 39, and its expression is optionally driven by one of a CMV, EFS, or hGRK1 promoter, as set out in SEQ ID NOs: 401-403 respectively. The nucleic acid also includes, in various cases, first and second inverted terminal repeat sequences (ITRs).

Continuing with this aspect of the disclosure, a nucleic acid comprising any or all of the features described above may be administered to the subject via an adeno-associated viral (AAV) vector, such as an AAV5 vector. The vector may be delivered to the retina of the subject (for example, by subretinal injection). Various embodiments of the method may be used in the treatment of human subjects. For example, the methods may be used to treat subjects suffering from a CEP290 associated disease such as LCA10, to restore CEP290 function in a subject in need thereof, and/or to alter a cell in the subject, such as a retinal cell and/or a photoreceptor cell.

In another aspect, this disclosure relates to a nucleic acid encoding a Cas9, a first gRNA with a targeting domain selected from SEQ ID NOs: 389-391 (corresponding RNA sequences in SEQ ID NOs: 530, 468, and 538, respectively), and a second gRNA with a targeting domain selected from SEQ ID NOs: 388, 392, and 394 (corresponding RNA sequences in SEQ ID NOs: 558, 460, and 568, respectively). The nucleic acid may, in various embodiments, incorporate any or all of the features described above (e.g., the NLS and/or polyadenylation signal; the CMV, EFS or hGRK1 promoter; and/or the ITRs). The nucleic acid may be part of an AAV vector, which vector may be used in medicine, for example to treat a CEP290 associated disease such as LCA10, and/or may be used to edit specific cells including retinal cells, for instance retinal photoreceptor cells. The nucleic acid may also be used for the production of a medicament.

In yet another aspect, this disclosure relates to a method of treating a subject that includes the step of contacting a retina of the subject with one or more recombinant viral vectors (e.g., AAV vectors) that encode a Cas9 and first and second gRNAs. The first and second gRNAs are adapted to form first and second ribonucleoprotein complexes with the Cas9, and the first and second complexes in turn are adapted to cleave first and second target sequences, respectively, on either side of a CEP290 target position as that term is defined below. This cleavage results in the alteration of the nucleic acid sequence of the CEP290 target position. In some embodiments, the step of contacting the retina with one or more recombinant viral vectors includes administering to the retina of the subject, by subretinal injection, a composition comprising the one or more recombinant viral vectors. The alteration of the nucleic acid sequence of the CEP290 target position can include formation of an indel, deletion of part or all of the CEP290 target position, and/or inversion of a nucleotide sequence in the CEP290 target position. The subject, in certain embodiments, is a primate.

The genome editing systems, compositions, and methods of the present disclosure can support high levels of productive editing in retinal cells, e.g., in photoreceptor cells. In certain embodiments, 10%, 15%, 20%, or 25% of retinal cells in samples modified according to the methods of this disclosure (e.g., in retinal samples contacted with a genome editing system of this disclosure) comprise a productive alteration of an allele of the CEP290 gene. A productive alteration may include, variously, a deletion and/or inversion of a sequence comprising an IVS26 mutation, or another modification that results in an increase in the expression of functional CEP290 protein in a cell. In certain embodiments, 25%, 30%, 35%, 40%, 45%, 50%, or more than 50% of photoreceptor cells in retinal samples modified according to the methods of this disclosure (e.g., in retinal samples contacted with a genome editing system of this disclosure) comprise a productive alteration of an allele of the CEP290 gene.

In another aspect, this disclosure relates to a nucleic acid encoding a Cas9 and first and second gRNAs targeted to a CEP290 gene of a subject for use in therapy, e.g. in the treatment of CEP290-associated disease. The CEP290 associated disease may be, in some embodiments, LCA10, and in other embodiments may be selected from the group consisting of Senior-Loken syndrome, Meckel Gruber syndrome, Bardet-Biedle syndrome and Joubert Syndrome. A targeting domain of the first gRNA may comprise a sequence selected from SEQ ID NOs: 389-391 (corresponding RNA sequences in SEQ ID NOs: 530, 468, and 538, respectively), and a targeting domain of the second gRNA may comprise a sequence selected from SEQ ID NOs: 388, 392, and 394, respectively (corresponding RNA sequences in SEQ ID NOs: 558, 460, and 568, respectively). In certain embodiments, the first and second gRNA targeting domains comprise SEQ ID NOs: 389 and 388, respectively. In other embodiments, the first and second gRNA targeting domains comprise the sequences of SEQ ID NOs: 389 and 392, respectively; SEQ ID NOs: 389 and 394, respectively; SEQ ID NOs: 390 and 388, respectively; SEQ ID NOs: 391 and 388, respectively; or SEQ ID NOs: 391 and 392, respectively. In still other embodiments, the first and second targeting domains comprise the sequences of SEQ ID NOs: 390 and 392, respectively; SEQ ID NOs: 390 and 394, respectively; or SEQ ID NOs: 391 and 394, respectively. The gRNAs according to this aspect of the disclosure may be unimolecular, and may comprise RNA sequences according to SEQ ID NOs: 2779 or 2786 (corresponding to the DNA sequences of SEQ ID NOs: 2785 and 2787, respectively). Alternatively, the gRNAs may be two-part modular gRNAs according to either sequence, where the crRNA component comprises the portion of SEQ ID NO: 2785/2779 or 2787/2786 that is underlined below, and the tracrRNA component comprises the portion that is double-underlined below:

DNA:
(SEQ ID NO: 2785)
[N]$_{16-24}$GTTTTAGTACTCTGGAAACAGAATCTACTAAAACAAGGCAAA

ATGCCGTGTTTATCTCGTCAACTTGTTGGCGAGATTTTTT
and

RNA:
(SEQ ID NO: 2779)
[N]$_{16-24}$GUUUUAGUACUCUGGAAACAGAAUCUACUAAAACAAGGCAAA

AUGCCGUGUUUAUCUCGUCAACUUGUUGGCGAGAUUUUUU.

DNA:
(SEQ ID NO: 2787)
[N]$_{16-24}$GTTATAGTACTCTGGAAACAGAATCTACTATAACAAGGCAAA

ATGCCGTGTTTATCTCGTCAACTTGTTGGCGAGATTTTTT
and

RNA:
(SEQ ID NO: 2786)
[N]$_{16-24}$GUUAUAGUACUCUGGAAACAGAAUCUACUAUAACAAGGCAAA

AUGCCGUGUUUAUCUCGUCAACUUGUUGGCGAGAUUUUUU.

Continuing with this aspect of the disclosure, the Cas9 encoded by the nucleic acid is, in certain embodiments, a *Staphylococcus aureus* Cas9, which may be encoded by a sequence comprising SEQ ID NO: 39, or having at least 80%, 85%, 90%, 95% or 99% sequence identity thereto. The Cas9 encoded by the nucleic acid may comprise the amino acid sequence of SEQ ID NO: 26 or may share at least 80%, 85%, 90%, 95% or 99% sequence identity therewith. The Cas9 may be modified in some instances, for example to include one or more nuclear localization signals (NLSs) (e.g., a C-terminal and an N-terminal NLS) and/or a polyadenylation signal. Cas9 expression may be driven by a promoter sequence such as the promoter sequence comprising SEQ ID NO: 401, the promoter sequence comprising SEQ ID NO: 402, or the promoter sequence comprising SEQ ID NO: 403.

Staying with this aspect of the disclosure, the promoter sequence for driving the expression of the Cas9 comprises, in certain embodiments, the sequence of a human GRK1 promoter. In other embodiments, the promoter comprises the sequence of a cytomegalovirus (CMV) promoter or an EFS promoter. For example, the nucleic acid may comprise, in various embodiments, (a) a CMV promoter for Cas9 and gRNAs comprising (or differing by no more than 3 nucleotides from) targeting domains according to SEQ ID NOs: 389 and 392, or (b) a CMV promoter for Cas9 and gRNAs comprising targeting domains according to SEQ ID NOs: 389 and 394, or c) a CMV promoter for Cas9 and gRNAs comprising targeting domains according to SEQ ID NOs: 390 and 388, or d) a CMV promoter for Cas9 and gRNAs comprising targeting domains according to SEQ ID NOs: 391 and 388, or e) a CMV promoter for Cas9 and gRNAs comprising targeting domains according to SEQ ID NOs: 391 and 392, or f) an EFS promoter for Cas9 and gRNAs comprising targeting domains according to SEQ ID NOs: 389 and 392, or g) an EFS promoter for Cas9 and gRNAs comprising targeting domains according to SEQ ID NOs: 389 and 394, or h) an EFS promoter for Cas9 and gRNAs comprising targeting domains according to SEQ ID NOs: 390 and 388, or i) an EFS promoter for Cas9 and gRNAs comprising targeting domains according to SEQ ID NOs: 391 and 388, or j) an EFS promoter for Cas9 and gRNAs comprising targeting domains according to SEQ ID NOs: 391 and 392, or k) an hGRK1 promoter for Cas9 and gRNAs comprising targeting domains according to SEQ ID NOs: 389 and 392, or g) an hGRK1 promoter for Cas9 and gRNAs comprising targeting domains according to SEQ ID NOs: 389 and 394, or h) an hGRK1 promoter for Cas9 and gRNAs comprising targeting domains according to SEQ ID NOs: 390 and 388, or i) an hGRK1 promoter for Cas9 and gRNAs comprising targeting domains according to SEQ ID NOs: 391 and 388, or j) an hGRK1 promoter for Cas9 and gRNAs comprising targeting domains according to SEQ ID NOs: 391 and 392. In other embodiments, the nucleic acid comprises a CMV promoter and guide RNA targeting sequences according to SEQ ID NOs: 389 and 388. In still other embodiments, the nucleic acid comprises an hGRK promoter and guide RNA targeting sequences according to SEQ ID NOs: 390 and 392, or it comprises a CMV promoter and guide RNA targeting sequences according to SEQ ID NOs: 390 and 392, or an hGRK promoter and guide RNA targeting sequences according to SEQ ID NOs: 390 and 394, or it comprises a CMV promoter and guide RNA targeting sequences according to SEQ ID NOs: 391 and 394, or an hGRK promoter and guide RNA targeting sequences according to SEQ ID NOs: 391 and 394, or it comprises a CMV promoter and guide RNA targeting sequences according to SEQ ID NOs: 390 and 392. And in further embodiments, the promoter is hGRK or CMV while the first and second gRNA targeting domains comprise the sequences of SEQ ID NOs: 389 and 392, SEQ ID NOs: 389 and 394, SEQ ID NOs: 390 and 388, SEQ ID NOs: 391 and 388, or SEQ ID NOs: 391 and 392.

In another aspect, the present disclosure relates to adeno-associated virus (AAV) vectors comprising the nucleic acids described above. AAV vectors comprising the foregoing nucleic acids may be administered to a variety of tissues of a subject, though in certain embodiments the AAV vectors are administered to a retina of the subject, and/or are administered by subretinal injection. The AAV vector may comprise an AAV5 capsid.

An additional aspect of this disclosure relates to a nucleic acid as described above, for delivery via an AAV vector also as described above. The nucleic acid includes in some embodiments, first and second inverted terminal repeat sequences (ITRs), a first guide RNA comprising a targeting domain sequence selected from SEQ ID NOs: 389-391 (corresponding RNA sequences in SEQ ID NOs: 530, 468, and 538, respectively), a second guide RNA comprising a targeting domain sequence selected from SEQ ID NOs: 388, 392, and 394 (corresponding RNA sequences in SEQ ID NOs: 558, 460, and 568, respectively), and a promoter for driving Cas9 expression comprising a sequence selected from SEQ ID NOs: 401-403. In certain embodiments, the nucleic acid includes first and second ITRs and first and second guide RNAs comprising a guide RNA sequence selected from SEQ ID NOs: 2785 and 2787 (e.g., both first and second guide RNAs comprise the sequence of SEQ ID NO: 2787). The nucleic acid may be used in the treatment of human subjects, and/or in the production of a medicament.

The nucleic acids and vectors according to these aspects of the disclosure may be used in medicine, for instance in the treatment of disease. In some embodiments, they are used in the treatment of a CEP290-associated disease, in the treatment of LCA10, or in the treatment of one or more of the following: Senior-Loken syndrome, Meckel Gruber syndrome, Bardet-Biedle syndrome, and/or Joubert Syndrome. Vectors and nucleic acids according to this disclosure may be administered to the retina of a subject, for instance by subretinal injection.

This disclosure also relates to recombinant viral vectors comprising the nucleic acids described above, and to the use of such viral vectors in the treatment of disease. In some embodiments, one or more viral vectors encodes a Cas9, a first gRNA and a second gRNA for use in a method of altering a nucleotide sequence of a CEP 290 target position wherein (a) the first and second gRNAs are adapted to form first and second ribonucleoprotein complexes with the Cas9, and (b) the first and second ribonucleoprotein complexes are adapted to cleave first and second cellular nucleic acid sequences on first and second sides of a CEP290 target position, thereby altering a nucleotide sequence of the CEP290 target position. In use, the one or more recombinant viral vectors is contacted to the retina of a subject, for instance by subretinal injection.

Another aspect of this disclosure relates to AAV vectors, AAV vector genomes and/or nucleic acids that may be carried by AAV vectors, which encode one or more guide RNAs, each comprising a sequence selected from—or having at least 90% sequence identity to—one of SEQ ID NOs: 2785 or 2787, a sequence encoding a Cas9 and a promoter sequence operably coupled to the Cas9 coding sequence, which promoter sequence comprises a sequence selected from—or having at least 90% sequence identity to—one of SEQ ID NOs: 401-403. The Cas9 coding sequence may comprise the sequence of SEQ ID NO: 39, or it may share at least 90% sequence identity therewith. Alternatively or additionally, the Cas9 coding sequence may encode an amino acid sequence comprising SEQ ID NO: 26, or sharing at least 90% sequence identity therewith. In certain embodiments, the AAV vector, vector genome or nucleic acid further comprises one or more of the following: left and right ITR sequences, optionally selected from—or having at least 90% sequence identity to—SEQ ID NOs: 408 and 437, respectively; and one or more U6 promoter sequences operably coupled to the one or more guide RNA sequences. The U6 promoter sequences may comprise, or share at least 90% sequence identity with, SEQ ID NO: 417.

Methods and compositions discussed herein, provide for treating or delaying the onset or progression of diseases of the eye, e.g., disorders that affect retinal cells, e.g., photoreceptor cells.

Methods and compositions discussed herein, provide for treating or delaying the onset or progression of Leber's Congenital Amaurosis 10 (LCA10), an inherited retinal degenerative disease characterized by severe loss of vision at birth. LCA10 is caused by a mutation in the CEP290 gene, e.g., a c.2991+1655A to G (adenine to guanine) mutation in the CEP290 gene which gives rise to a cryptic splice site in intron 26. This is a mutation at nucleotide 1655 of intron 26 of CEP290, e.g., an A to G mutation. CEP290 is also known as: CT87; MKS4; POC3; rd16; BBS14; JBTS5; LCA10; NPHP6; SLSN6; and 3H11Ag.

Methods and compositions discussed herein, provide for treating or delaying the onset or progression of LCA10 by gene editing, e.g., using CRISPR-Cas9 mediated methods to alter a LCA10 target position, as disclosed below.

"LCA10 target position" as used herein refers to nucleotide 1655 of intron 26 of the CEP290 gene, and the mutation at that site that gives rise to a cryptic splice donor site in intron 26 which results in the inclusion of an aberrant exon of 128 bp (c.2991+1523 to c.2991+1650) in the mutant CEP290 mRNA, and inserts a premature stop codon (p.C998X). The sequence of the cryptic exon contains part of an Alu repeat region. The Alu repeats span from c.2991+1162 to c.2991+1638. In an embodiment, the LCA10 target position is occupied by an adenine (A) to guanine (G) mutation (c.2991+1655A to G).

In one aspect, methods and compositions discussed herein, provide for altering a LCA10 target position in the CEP290 gene. The methods and compositions described herein introduce one or more breaks near the site of the LCA target position (e.g., c.2991+1655A to G) in at least one allele of the CEP290 gene. Altering the LCA10 target position refers to (1) break-induced introduction of an indel (also referred to herein as NHEJ-mediated introduction of an indel) in close proximity to or including a LCA10 target position (e.g., c.2991+1655A to G), or (2) break-induced deletion (also referred to herein as NHEJ-mediated deletion) of genomic sequence including the mutation at a LCA10 target position (e.g., c.2991+1655A to G). Both approaches give rise to the loss or destruction of the cryptic splice site resulting from the mutation at the LCA10 target position (e.g., c.2991+1655A to G).

In an embodiment, a single strand break is introduced in close proximity to or at the LCA10 target position (e.g., c.2991+1655A to G) in the CEP290 gene. While not wishing to be bound by theory, it is believed that break-induced indels (e.g., indels created following NHEJ) destroy the cryptic splice site. In an embodiment, the single strand break will be accompanied by an additional single strand break, positioned by a second gRNA molecule.

In an embodiment, a double strand break is introduced in close proximity to or at the LCA10 target position (e.g., c.2991+1655A to G) in the CEP290 gene. While not wishing to be bound by theory, it is believed that break-induced indels (e.g., indels created following NHEJ) destroy the cryptic splice site. In an embodiment, a double strand break will be accompanied by an additional single strand break may be positioned by a second gRNA molecule. In an embodiment, a double strand break will be accompanied by two additional single strand breaks positioned by a second gRNA molecule and a third gRNA molecule.

In an embodiment, a pair of single strand breaks is introduced in close proximity to or at the LCA10 target position (e.g., c.2991+1655A to G) in the CEP290 gene. While not wishing to be bound by theory, it is believed that break-induced indels destroy the cryptic splice site. In an embodiment, the pair of single strand breaks will be accompanied by an additional double strand break, positioned by a third gRNA molecule. In an embodiment, the pair of single strand breaks will be accompanied by an additional pair of single strand breaks positioned by a third gRNA molecule and a fourth gRNA molecule.

In an embodiment, two double strand breaks are introduced to flank the LCA10 target position in the CEP290 gene (one 5' and the other one 3' to the mutation at the LCA10 target position, e.g., c.2991+1655A to G) to remove (e.g., delete) the genomic sequence including the mutation at the LCA10 target position. It is contemplated herein that in an embodiment the break-induced deletion of the genomic sequence including the mutation at the LCA10 target position is mediated by NHEJ. In an embodiment, the breaks (i.e., the two double strand breaks) are positioned to avoid unwanted target chromosome elements, such as repeat elements, e.g., an Alu repeat. The breaks, i.e., two double strand breaks, can be positioned upstream and downstream of the LCA10 target position, as discussed herein.

In an embodiment, one double strand break (either 5' or 3' to the mutation at the LCA10 target position, e.g., c.2991+1655A to G) and two single strand breaks (on the other side of the mutation at the LCA10 target position from the double strand break) are introduced to flank the LCA10 target position in the CEP290 gene to remove (e.g., delete) the genomic sequence including the mutation at the LCA10 target position. It is contemplated herein that in an embodiment the break-induced deletion of the genomic sequence including the mutation at the LCA10 target position is mediated by NHEJ. In an embodiment, the breaks (i.e., the double strand break and the two single strand breaks) are positioned to avoid unwanted target chromosome elements, such as repeat elements, e.g., an Alu repeat. The breaks, e.g., one double strand break and two single strand breaks, can be positioned upstream and downstream of the LCA10 target position, as discussed herein.

In an embodiment, two pairs of single strand breaks (two 5' and the other two 3' to the mutation at the LCA10 target position, e.g., c.2991+1655A to G) are introduced to flank the LCA10 target position in the CEP290 gene to remove (e.g., delete) the genomic sequence including the mutation at the LCA10 target position. It is contemplated herein that in an embodiment the break-induced deletion of the genomic sequence including the mutation at the LCA10 target position is mediated by NHEJ. In an embodiment, the breaks (e.g., two pairs of single strand breaks) are positioned to avoid unwanted target chromosome elements, such as repeat elements, e.g., an Alu repeat. The breaks, e.g., two pairs of single strand breaks, can be positioned upstream or downstream of the LCA10 target position, as discussed herein.

The LCA10 target position may be targeted by cleaving with either a single nuclease or dual nickases, e.g., to induce break-induced indel in close proximity to or including the LCA10 target position or break-induced deletion of genomic sequence including the mutation at the LCA10 target position in the CEP290 gene. The method can include acquiring knowledge of the mutation carried by the subject, e.g., by sequencing the appropriate portion of the CEP290 gene.

In one aspect, disclosed herein is a gRNA molecule, e.g., an isolated or non-naturally occurring gRNA molecule, comprising a targeting domain which is complementary with a target domain from the CEP290 gene.

When two or more gRNAs are used to position two or more cleavage events, e.g., double strand or single strand breaks, in a target nucleic acid, it is contemplated that in an embodiment the two or more cleavage events may be made by the same or different Cas9 proteins. For example, when two gRNAs are used to position two double strand breaks, a single Cas9 nuclease may be used to create both double strand breaks. When two or more gRNAs are used to position two or more single stranded breaks (single strand breaks), a single Cas9 nickase may be used to create the two or more single strand breaks. When two or more gRNAs are used to position at least one double strand break and at least one single strand break, two Cas9 proteins may be used, e.g., one Cas9 nuclease and one Cas9 nickase. It is contemplated that in an embodiment when two or more Cas9 proteins are used that the two or more Cas9 proteins may be delivered sequentially to control specificity of a double strand versus a single strand break at the desired position in the target nucleic acid.

In some embodiments, the targeting domain of the first gRNA molecule and the targeting domain of the second gRNA molecule hybridize to the target domain from the target nucleic acid molecule (i.e., the CEP290 gene) through complementary base pairing to opposite strands of the target nucleic acid molecule. In some embodiments, the first gRNA molecule and the second gRNA molecule are configured such that the PAMs are oriented outward.

In an embodiment, the targeting domain of a gRNA molecule is configured to avoid unwanted target chromosome elements, such as repeat elements, e.g., an Alu repeat, or the endogenous CEP290 splice sites, in the target domain. The gRNA molecule may be a first, second, third and/or fourth gRNA molecule.

In an embodiment, the targeting domain of a gRNA molecule is configured to position a cleavage event sufficiently far from a preselected nucleotide, e.g., the nucleotide of a coding region, such that the nucleotide is not altered. In an embodiment, the targeting domain of a gRNA molecule is configured to position an intronic cleavage event sufficiently far from an intron/exon border, or naturally occurring splice signal, to avoid alteration of the exonic sequence or unwanted splicing events. The gRNA molecule may be a first, second, third and/or fourth gRNA molecule, as described herein.

In an embodiment, the LCA10 target position in the CEP290 gene is targeted. In an embodiment, the targeting domain comprises a sequence that is the same as, or differs by no more than 1, 2, 3, 4, or 5 nucleotides from, a targeting domain sequence from Table 11. In some embodiments, the targeting domain is selected from those in Table 11. For example, in certain embodiments, the targeting domain is:

GACACTGCCAATAGGGATAGGT; (SEQ ID NO: 387)

GTCAAAAGCTACCGGTTACCTG; (SEQ ID NO: 388)

GTTCTGTCCTCAGTAAAAGGTA; (SEQ ID NO: 389)

GAATAGTTTGTTCTGGGTAC; (SEQ ID NO: 390)

GAGAAAGGGATGGGCACTTA; (SEQ ID NO: 391)

GATGCAGAACTAGTGTAGAC; (SEQ ID NO: 392)

GTCACATGGGAGTCACAGGG; (SEQ ID NO: 393)
or

GAGTATCTCCTGTTTGGCA. (SEQ ID NO: 394)

In an embodiment, when two or more gRNAs are used to position two or more breaks, e.g., two or more single strand breaks in the target nucleic acid sequence, each guide RNA is independently selected from one of Table 11. In an embodiment, the two or more gRNAs or targeting domains are selected from one or more of the pairs of gRNAs or targeting domains described herein, e.g., as indicated in Table 11. In an embodiment, when two or more gRNAs are used to position four breaks, e.g., four single strand breaks in the target nucleic acid sequence, each guide RNA is independently selected from one of Table 11.

In an embodiment, the LCA10 target position in the CEP290 gene is targeted. In an embodiment, the targeting domain comprises a sequence that is the same as, or differs by no more than 1, 2, 3, 4, or 5 nucleotides from, a targeting domain sequence from Table 2A-2D. In some embodiments, the targeting domain is selected from those in Table 2A-2D. For example, in certain embodiments, the targeting domain is:

GAGAUACUCACAAUUACAAC; (SEQ ID NO: 395)
or

GAUACUCACAAUUACAACUG. (SEQ ID NO: 396)

In an embodiment, when two or more gRNAs are used to position two or more breaks, e.g., two or more single strand breaks in the target nucleic acid sequence, each guide RNA is independently selected from one of Tables 2A-2D. In an embodiment, when two or more gRNAs are used to position four breaks, e.g., four single strand breaks in the target nucleic acid sequence, each guide RNA is independently selected from one of Tables 2A-2D.

In an embodiment, the LCA10 target position in the CEP290 gene is targeted. In an embodiment, the targeting domain comprises a sequence that is the same as, or differs by no more than 1, 2, 3, 4, or 5 nucleotides from, a targeting domain sequence from Tables 3A-3C. In some embodiments, the targeting domain is selected from those in Tables 3A-3C. For example, in certain embodiments, the targeting domain is:

GAGAUACUCACAAUUACAAC; (SEQ ID NO: 395)
or

GAUACUCACAAUUACAA. (SEQ ID NO: 397)

In an embodiment, when two or more gRNAs are used to position two or more breaks, e.g., two or more single stranded breaks in the target nucleic acid sequence, each guide RNA is independently selected from one of Tables 3A-3C. In an embodiment, when two or more gRNAs are used to position four breaks, e.g., four single strand breaks in the target nucleic acid sequence, each guide RNA is independently selected from one of Tables 3A-3C.

In an embodiment, the LCA10 target position in the CEP290 gene is targeted. In an embodiment, the targeting domain comprises a sequence that is the same as, or differs by no more than 1, 2, 3, 4, or 5 nucleotides from, a targeting domain sequence from Tables 7A-7D. In some embodiments, the targeting domain is selected from those in Tables 7A-7D. For example, in certain embodiments, the targeting domain is:

```
                                     (SEQ ID NO: 398)
        GCACCUGGCCCCAGUUGUAAUU.
```

In an embodiment, when two or more gRNAs are used to position two or more breaks, e.g., two or more single stranded breaks in the target nucleic acid sequence, each guide RNA is independently selected from one of Tables 7A-7D. In an embodiment, when two or more gRNAs are used to position four breaks, e.g., four single strand breaks in the target nucleic acid sequence, each guide RNA is independently selected from one of Tables 7A-7D.

In an embodiment, the LCA10 target position in the CEP290 gene is targeted. In an embodiment, the targeting domain comprises a sequence that is the same as, or differs by no more than 1, 2, 3, 4, or 5 nucleotides from, a targeting domain sequence from Tables 4A-4D. In some embodiments, the targeting domain is selected from those in Tables 4A-4D. For example, in certain embodiments, the targeting domain is:

```
                             (SEQ ID NO: 457)
    GCUACCGGUUACCUGAA;

(SEQ ID NO: 458)
    GCAGAACUAGUGUAGAC;

(SEQ ID NO: 459)
    GUUGAGUAUCUCCUGUU;

(SEQ ID NO: 460)
    GAUGCAGAACUAGUGUAGAC;
    or (SEQ ID NO: 461)
    GCUUGAACUCUGUGCCAAAC.
```

In an embodiment, when two or more gRNAs are used to position two or more breaks, e.g., two or more single stranded breaks in the target nucleic acid sequence, each guide RNA is independently selected from one of Tables 4A-4D. In an embodiment, when two or more gRNAs are used to position four breaks, e.g., four single strand breaks in the target nucleic acid sequence, each guide RNA is independently selected from one of Tables 4A-4D.

In an embodiment, the LCA10 target position in the CEP290 gene is targeted. In an embodiment, the targeting domain comprises a sequence that is the same as, or differs by no more than 1, 2, 3, 4, or 5 nucleotides from, a targeting domain sequence from Tables 8A-8D. In some embodiments, the targeting domain is selected from those in Tables 8A-8D. For example, in certain embodiments, the targeting domain is:

```
                         (SEQ ID NO: 457)
GCUACCGGUUACCUGAA;

(SEQ ID NO: 458)
GCAGAACUAGUGUAGAC;

(SEQ ID NO: 459)
GUUGAGUAUCUCCUGUU;

(SEQ ID NO: 460)
GAUGCAGAACUAGUGUAGAC;

(SEQ ID NO: 461)
GCUUGAACUCUGUGCCAAAC;

(SEQ ID NO: 462)
GAAAGAUGAAAAAUACUCUU;

(SEQ ID NO: 463)
GAAAUAGAUGUAGAUUG;

(SEQ ID NO: 464)
GAAAUAUUAAGGGCUCUUCC;

(SEQ ID NO: 465)
GAACAAAAGCCAGGGACCAU;

(SEQ ID NO: 466)
GAACUCUAUACCUUUUACUG;

(SEQ ID NO: 467)
GAAGAAUGGAAUAGAUAAUA;

(SEQ ID NO: 468)
GAAUAGUUUGUUCUGGGUAC;

(SEQ ID NO: 469)
GAAUGGAAUAGAUAAUA;

(SEQ ID NO: 470)
GAAUUUACAGAGUGCAUCCA;

(SEQ ID NO: 471)
GAGAAAAAGGAGCAUGAAAC;

(SEQ ID NO: 472)
GAGAGCCACAGUGCAUG;

(SEQ ID NO: 473)
GAGGUAGAAUCAAGAAG;

(SEQ ID NO: 474)
GAGUGCAUCCAUGGUCC;

(SEQ ID NO: 475)
GAUAACUACAAAGGGUC;

(SEQ ID NO: 476)
GAUAGAGACAGGAAUAA;

(SEQ ID NO: 477)
GAUGAAAAAUACUCUUU;

(SEQ ID NO: 478)
GAUGACAUGAGGUAAGU;

(SEQ ID NO: 479)
GCAUGUGGUGUCAAAUA;

(SEQ ID NO: 480)
GCCUGAACAAGUUUUGAAAC;

(SEQ ID NO: 481)
GCUCUUUUCUAUAUAUA;

(SEQ ID NO: 482)
GCUUUUGACAGUUUUUAAGG;

(SEQ ID NO: 483)
GCUUUUGUUCCUUGGAA;
```

GGAACAAAAGCCAGGGACCA; (SEQ ID NO: 484)

GGACUUGACUUUUACCCUUC; (SEQ ID NO: 485)

GGAGAAUAGUUUGUUCU; (SEQ ID NO: 486)

GGAGUCACAUGGGAGUCACA; (SEQ ID NO: 487)

GGAUAGGACAGAGGACA; (SEQ ID NO: 488)

GGCUGUAAGAUAACUACAAA; (SEQ ID NO: 489)

GGGAGAAUAGUUUGUUC; (SEQ ID NO: 490)

GGGAGUCACAUGGGAGUCAC; (SEQ ID NO: 491)

GGGCUCUUCCUGGACCA; (SEQ ID NO: 492)

GGGUACAGGGGUAAGAGAAA; (SEQ ID NO: 493)

GGUCCCUGGCUUUUGUUCCU; (SEQ ID NO: 494)

GUAAAGGUUCAUGAGACUAG; (SEQ ID NO: 495)

GUAACAUAAUCACCUCUCUU; (SEQ ID NO: 496)

GUAAGACUGGAGAUAGAGAC; (SEQ ID NO: 497)

GUACAGGGGUAAGAGAA; (SEQ ID NO: 498)

GUAGCUUUUGACAGUUUUA; (SEQ ID NO: 499)

GUCACAUGGGAGUCACA; (SEQ ID NO: 500)

GUGGAGAGCCACAGUGCAUG; (SEQ ID NO: 501)

GUUACAAUCUGUGAAUA; (SEQ ID NO: 502)

GUUCUGUCCUCAGUAAA; (SEQ ID NO: 503)

GUUUAGAAUGAUCAUUCUUG; (SEQ ID NO: 504)

GUUUGUUCUGGGUACAG; (SEQ ID NO: 505)

UAAAAACUGUCAAAAGCUAC; (SEQ ID NO: 506)

UAAAAGGUAUAGAGUUCAAG; (SEQ ID NO: 507)

UAAAUCAUGCAAGUGACCUA; (SEQ ID NO: 508)
or

UAAGAUAACUACAAAGGGUC. (SEQ ID NO: 509)

In an embodiment, when two or more gRNAs are used to position two or more breaks, e.g., two or more single stranded breaks in the target nucleic acid sequence, each guide RNA is independently selected from one of Tables 8A-8D. In an embodiment, when two or more gRNAs are used to position four breaks, e.g., four single strand breaks in the target nucleic acid sequence, each guide RNA is independently selected from one of Tables 8A-8D.

In an embodiment, the LCA10 target position in the CEP290 gene is targeted. In an embodiment, the targeting domain comprises a sequence that is the same as, or differs by no more than 1, 2, 3, 4, or 5 nucleotides from, a targeting domain sequence from Table 5A-5D. In some embodiments, the targeting domain is selected from those in Table 5A-5D. For example, in certain embodiments, the targeting domain is:

GAAUCCUGAAAGCUACU (SEQ ID NO: 510).

In an embodiment, when two or more gRNAs are used to position two or more breaks, e.g., two or more single stranded breaks in the target nucleic acid sequence, each guide RNA is independently selected from one of Tables 5A-5D. In an embodiment, when two or more gRNAs are used to position four breaks, e.g., four single strand breaks in the target nucleic acid sequence, each guide RNA is independently selected from one of Tables 5A-5D.

In an embodiment, the LCA10 target position in the CEP290 gene is targeted. In an embodiment, the targeting domain comprises a sequence that is the same as, or differs by no more than 1, 2, 3, 4, or 5 nucleotides from, a targeting domain sequence from Tables 9A-9E. In some embodiments, the targeting domain is selected from those in Tables 9A-9E. For example, in certain embodiments, the targeting domain is:

GAUGCAGAACUAGUGUAGAC; (SEQ ID NO: 460)

GAAUAGUUUGUUCUGGGUAC; (SEQ ID NO: 468)

GCCUGAACAAGUUUUGAAAC; (SEQ ID NO: 480)

GGUCCCUGGCUUUUGUUCCU; (SEQ ID NO: 494)

GUAAGACUGGAGAUAGAGAC; (SEQ ID NO: 497)

GCUAAAUCAUGCAAGUGACCUAAG; (SEQ ID NO: 511)

GGUCACUUGCAUGAUUUAG; (SEQ ID NO: 512)

GUCACUUGCAUGAUUUAG; (SEQ ID NO: 513)

GCCUAGGACUUUCUAAUGCUGGA; (SEQ ID NO: 514)

GGACUUUCUAAUGCUGGA; (SEQ ID NO: 515)

GGGACCAUGGGAGAAUAGUUUGUU; (SEQ ID NO: 516)

GGACCAUGGGAGAAUAGUUUGUU; (SEQ ID NO: 517)

GACCAUGGGAGAAUAGUUUGUU; (SEQ ID NO: 518)

GGUCCCUGGCUUUUGUUCCUUGGA; (SEQ ID NO: 519)

-continued

GUCCCUGGCUUUUGUUCCUUGGA; (SEQ ID NO: 520)

GAAAACGUUGUUCUGAGUAGCUUU; (SEQ ID NO: 521)

GUUGUUCUGAGUAGCUUU; (SEQ ID NO: 522)

GUCCCUGGCUUUUGUUCCU; (SEQ ID NO: 523)

GACAUCUUGUGGAUAAUGUAUCA; (SEQ ID NO: 524)

GUCCUAGGCAAGAGACAUCUU; (SEQ ID NO: 525)

GCCAGCAAAAGCUUUUGAGCUAA; (SEQ ID NO: 526)

GCAAAAGCUUUUGAGCUAA; (SEQ ID NO: 527)

GAUCUUAUUCUACUCCUGUGA; (SEQ ID NO: 528)

GCUUUCAGGAUUCCUACUAAAUU; (SEQ ID NO: 529)

GUUCUGUCCUCAGUAAAAGGUA; (SEQ ID NO: 530)

GAACAACGUUUUCAUUUA; (SEQ ID NO: 531)

GUAGAAUAUCAUAAGUUACAAUCU; (SEQ ID NO: 532)

GAAUAUCAUAAGUUACAAUCU; (SEQ ID NO: 533)

GUGGCUGUAAGAUAACUACA; (SEQ ID NO: 534)

GGCUGUAAGAUAACUACA; (SEQ ID NO: 535)

GUUUAACGUUAUCAUUUUCCCA; (SEQ ID NO: 536)

GUAAGAGAAAGGGAUGGGCACUUA; (SEQ ID NO: 537)

GAGAAAGGGAUGGGCACUUA; (SEQ ID NO: 538)

GAAAGGGAUGGGCACUUA; (SEQ ID NO: 539)

GUAAAUGAAAACGUUGUU; (SEQ ID NO: 540)

GAUAAACAUGACUCAUAAUUUAGU; (SEQ ID NO: 541)

GGAACAAAGCCAGGGACCAUGG; (SEQ ID NO: 542)

GAACAAAGCCAGGGACCAUGG; (SEQ ID NO: 543)

GGGAGAAUAGUUUGUUCUGGGUAC; (SEQ ID NO: 544)

GGAGAAUAGUUUGUUCUGGGUAC; (SEQ ID NO: 545)

GAGAAUAGUUUGUUCUGGGUAC; (SEQ ID NO: 546)

GAAAUAGAGGCUUAUGGAUU; (SEQ ID NO: 547)

GUUCUGGGUACAGGGGUAAGAGAA; (SEQ ID NO: 548)

GGGUACAGGGGUAAGAGAA; (SEQ ID NO: 549)

GGUACAGGGGUAAGAGAA; (SEQ ID NO: 550)

GUAAAUUCUCAUCAUUUUUAUUG; (SEQ ID NO: 551)

GGAGAGGAUAGGACAGAGGACAUG; (SEQ ID NO: 552)

GAGAGGAUAGGACAGAGGACAUG; (SEQ ID NO: 553)

GAGGAUAGGACAGAGGACAUG; (SEQ ID NO: 554)

GGAUAGGACAGAGGACAUG; (SEQ ID NO: 555)

GAUAGGACAGAGGACAUG; (SEQ ID NO: 556)

GAAUAAAUGUAGAAUUUUAAUG; (SEQ ID NO: 557)

GUCAAAGCUACCGGUUACCUG; (SEQ ID NO: 558)

GUUUUUAAGGCGGGGAGUCACAU; (SEQ ID NO: 559)

GUCUUACAUCCUCCUUACUGCCAC; (SEQ ID NO: 560)

GAGUCACAGGGUAGGAUUCAUGUU; (SEQ ID NO: 561)

GUCACAGGGUAGGAUUCAUGUU; (SEQ ID NO: 562)

GGCACAGAGUUCAAGCUAAUACAU; (SEQ ID NO: 563)

GCACAGAGUUCAAGCUAAUACAU; (SEQ ID NO: 564)

GAGUUCAAGCUAAUACAU; (SEQ ID NO: 565)

GUGUUGAGUAUCUCCUGUUUGGCA; (SEQ ID NO: 566)

GUUGAGUAUCUCCUGUUUGGCA; (SEQ ID NO: 567)

GAGUAUCUCCUGUUUGGCA; (SEQ ID NO: 568)

GAAAAUCAGAUUUCAUGUGUG; (SEQ ID NO: 569)

GCCACAAGAAUGAUCAUUCUAAAC; (SEQ ID NO: 570)

GGCGGGGAGUCACAUGGGAGUCA; (SEQ ID NO: 571)

GCGGGGAGUCACAUGGGAGUCA; (SEQ ID NO: 572)

GGGGAGUCACAUGGGAGUCA; (SEQ ID NO: 573)

```
                                        (SEQ ID NO: 574)
GGGAGUCACAUGGGAGUCA;

(SEQ ID NO: 575)
GGAGUCACAUGGGAGUCA;

(SEQ ID NO: 576)
GCUUUUGACAGUUUUUAAGGCG;

(SEQ ID NO: 577)
GAUCAUUCUUGUGGCAGUAAG;

(SEQ ID NO: 578)
GAGCAAGAGAUGAACUAG;

(SEQ ID NO: 579)
GUAGAUUGAGGUAGAAUCAAGAA;

(SEQ ID NO: 580)
GAUUGAGGUAGAAUCAAGAA;

(SEQ ID NO: 581)
GGAUGUAAGACUGGAGAUAGAGAC;

(SEQ ID NO: 582)
GAUGUAAGACUGGAGAUAGAGAC;

(SEQ ID NO: 583)
GGGAGUCACAUGGGAGUCACAGGG;

(SEQ ID NO: 584)
GGAGUCACAUGGGAGUCACAGGG;

(SEQ ID NO: 585)
GAGUCACAUGGGAGUCACAGGG;

(SEQ ID NO: 586)
GUCACAUGGGAGUCACAGGG;

(SEQ ID NO: 587)
GUUUACAUAUCUGUCUUCCUUAA;
or (SEQ ID NO: 588)
GAUUUCAUGUGUGAAGAA.
```

In an embodiment, when two or more gRNAs are used to position two or more breaks, e.g., two or more single stranded breaks in the target nucleic acid sequence, each guide RNA is independently selected from one of Tables 9A-9E. In an embodiment, when two or more gRNAs are used to position four breaks, e.g., four single strand breaks in the target nucleic acid sequence, each guide RNA is independently selected from one of Tables 9A-9E.

In an embodiment, the LCA10 target position in the CEP290 gene is targeted. In an embodiment, the targeting domain comprises a sequence that is the same as, or differs by no more than 1, 2, 3, 4, or 5 nucleotides from, a targeting domain sequence from Tables 6A-6B. In some embodiments, the targeting domain is selected from those in Tables 6A-6B. For example, in certain embodiments, the targeting domain is:

```
                                        (SEQ ID NO: 589)
GAGUUCAAGCUAAUACAUGA;

(SEQ ID NO: 590)
GUUGUUCUGAGUAGCUU;
or (SEQ ID NO: 591)
GGCAAAAGCAGCAGAAAGCA.
```

In an embodiment, when two or more gRNAs are used to position two or more breaks, e.g., two or more single stranded breaks in the target nucleic acid sequence, each guide RNA is independently selected from one of Tables 6A-6B. In an embodiment, when two or more gRNAs are used to position four breaks, e.g., four single strand breaks in the target nucleic acid sequence, each guide RNA is independently selected from one of Tables 6A-6B.

In an embodiment, the LCA10 target position in the CEP290 gene is targeted. In an embodiment, the targeting domain comprises a sequence that is the same as, or differs by no more than 1, 2, 3, 4, or 5 nucleotides from, a targeting domain sequence from Tables 10A-10B. In some embodiments, the targeting domain is selected from those in Tables 10A-10B. For example, in certain embodiments, the targeting domain is:

```
                                        (SEQ ID NO: 589)
GAGUUCAAGCUAAUACAUGA;

(SEQ ID NO: 590)
GUUGUUCUGAGUAGCUU;

(SEQ ID NO: 591)
GGCAAAAGCAGCAGAAAGCA;

(SEQ ID NO: 592)
GUGGCUGAAUGACUUCU;
or (SEQ ID NO: 593)
GACUAGAGGUCACGAAA.
```

In an embodiment, when two or more gRNAs are used to position two or more breaks, e.g., two or more single stranded breaks in the target nucleic acid sequence, each guide RNA is independently selected from one of Tables 10A-10B. In an embodiment, when two or more gRNAs are used to position four breaks, e.g., four single strand breaks in the target nucleic acid sequence, each guide RNA is independently selected from one of Tables 10A-10B.

In an embodiment, the gRNA, e.g., a gRNA comprising a targeting domain, which is complementary with a target domain from the CEP290 gene, is a modular gRNA. In other embodiments, the gRNA is a chimeric gRNA.

In an embodiment, when two gRNAs are used to position two breaks, e.g., two single strand breaks, in the target nucleic acid sequence, each guide RNA is independently selected from one or more of Tables 2A-2D, Tables 3A-3C, Tables 4A-4D, Tables 5A-5D, Tables 6A-6B, Tables 7A-7D, Tables 8A-8D, Tables 9A-9E, Tables 10A-10B, or Table 11.

In an embodiment, the targeting domain which is complementary with a target domain from the CEP290 gene comprises 16 or more nucleotides in length. In an embodiment, the targeting domain which is complementary with a target domain from the CEP290 gene is 16 nucleotides or more in length. In an embodiment, the targeting domain is 16 nucleotides in length. In an embodiment, the targeting domain is 17 nucleotides in length. In an embodiment, the targeting domain is 18 nucleotides in length. In an embodiment, the targeting domain is 19 nucleotides in length. In an embodiment, the targeting domain is 20 nucleotides in length. In an embodiment, the targeting domain is 21 nucleotides in length. In an embodiment, the targeting domain is 22 nucleotides in length. In an embodiment, the targeting domain is 23 nucleotides in length. In an embodiment, the targeting domain is 24 nucleotides in length. In an embodiment, the targeting domain is 25 nucleotides in length. In an embodiment, the targeting domain is 26 nucleotides in length.

In an embodiment, the targeting domain comprises 16 nucleotides.

In an embodiment, the targeting domain comprises 17 nucleotides.

In an embodiment, the targeting domain comprises 18 nucleotides.

In an embodiment, the targeting domain comprises 19 nucleotides.

In an embodiment, the targeting domain comprises 20 nucleotides.

In an embodiment, the targeting domain comprises 21 nucleotides.

In an embodiment, the targeting domain comprises 22 nucleotides.

In an embodiment, the targeting domain comprises 23 nucleotides.

In an embodiment, the targeting domain comprises 24 nucleotides.

In an embodiment, the targeting domain comprises 25 nucleotides.

In an embodiment, the targeting domain comprises 26 nucleotides.

A gRNA as described herein may comprise from 5' to 3': a targeting domain (comprising a "core domain", and optionally a "secondary domain"); a first complementarity domain; a linking domain; a second complementarity domain; a proximal domain; and a tail domain. In some embodiments, the proximal domain and tail domain are taken together as a single domain.

In an embodiment, a gRNA comprises a linking domain of no more than 25 nucleotides in length; a proximal and tail domain, that taken together, are at least 20 nucleotides in length; and a targeting domain of equal to or greater than 16, 17, 18, 19, 20, 21, 22, 23, 24, 25 or 26 nucleotides in length.

In another embodiment, a gRNA comprises a linking domain of no more than 25 nucleotides in length; a proximal and tail domain, that taken together, are at least 30 nucleotides in length; and a targeting domain of equal to or greater than 16, 17, 18, 19, 20, 21, 22, 23, 24, 25 or 26 nucleotides in length.

In another embodiment, a gRNA comprises a linking domain of no more than 25 nucleotides in length; a proximal and tail domain, that taken together, are at least 30 nucleotides in length; and a targeting domain of equal to or greater than 16, 17, 18, 19, 20, 21, 22, 23, 24, 25 or 26 nucleotides in length.

In another embodiment, a gRNA comprises a linking domain of no more than 25 nucleotides in length; a proximal and tail domain, that taken together, are at least 40 nucleotides in length; and a targeting domain of equal to or greater than 16, 17, 18, 19, 20, 21, 22, 23, 24, 25 or 26 nucleotides in length.

A cleavage event, e.g., a double strand or single strand break, is generated by a Cas9 molecule. The Cas9 molecule may be an enzymatically active Cas9 (eaCas9) molecule, e.g., an eaCas9 molecule that forms a double strand break in a target nucleic acid or an eaCas9 molecule forms a single strand break in a target nucleic acid (e.g., a nickase molecule).

In an embodiment, the eaCas9 molecule catalyzes a double strand break.

In some embodiments, the eaCas9 molecule comprises HNH-like domain cleavage activity but has no, or no significant, N-terminal RuvC-like domain cleavage activity. In this case, the eaCas9 molecule is an HNH-like domain nickase, e.g., the eaCas9 molecule comprises a mutation at D10, e.g., D10A. In other embodiments, the eaCas9 molecule comprises N-terminal RuvC-like domain cleavage activity but has no, or no significant, HNH-like domain cleavage activity. In an embodiment, the eaCas9 molecule is an N-terminal RuvC-like domain nickase, e.g., the eaCas9 molecule comprises a mutation at H840, e.g., H840A. In an embodiment, the eaCas9 molecule is an N-terminal RuvC-like domain nickase, e.g., the eaCas9 molecule comprises a mutation at H863, e.g., H863A.

In an embodiment, a single strand break is formed in the strand of the target nucleic acid to which the targeting domain of said gRNA is complementary. In another embodiment, a single strand break is formed in the strand of the target nucleic acid other than the strand to which the targeting domain of said gRNA is complementary.

In another aspect, disclosed herein is a nucleic acid, e.g., an isolated or non-naturally occurring nucleic acid, e.g., DNA, that comprises (a) a sequence that encodes a gRNA molecule comprising a targeting domain that is complementary with a target domain in CEP290 gene as disclosed herein.

In an embodiment, the nucleic acid encodes a gRNA molecule, e.g., the first gRNA molecule, comprising a targeting domain comprising a sequence that is the same as, or differs by no more than 1, 2, 3, 4, or 5 nucleotides from, a targeting domain sequence from any one of Tables 2A-2D, Tables 3A-3C, Tables 4A-4D, Tables 5A-5D, Tables 6A-6B, Tables 7A-7D, Tables 8A-8D, Tables 9A-9E, Tables 10A-10B, or Table 11. In an embodiment, the nucleic acid encodes a gRNA molecule comprising a targeting domain that is selected from those in Tables 2A-2D, Tables 3A-3C, Tables 4A-4D, Tables 5A-5D, Tables 6A-6B, Tables 7A-7D, Tables 8A-8D, Tables 9A-9E, Tables 10A-10B, or Table 11.

In an embodiment, the nucleic acid encodes a modular gRNA, e.g., one or more nucleic acids encode a modular gRNA. In other embodiments, the nucleic acid encodes a chimeric gRNA. The nucleic acid may encode a gRNA, e.g., the first gRNA molecule, comprising a targeting domain comprising 16 nucleotides or more in length. In one embodiment, the nucleic acid encodes a gRNA, e.g., the first gRNA molecule, comprising a targeting domain that is 16 nucleotides in length. In other embodiments, the nucleic acid encodes a gRNA, e.g., the first gRNA molecule, comprising a targeting domain that is 17 nucleotides in length. In still other embodiments, the nucleic acid encodes a gRNA, e.g., the first gRNA molecule, comprising a targeting domain that is 18 nucleotides in length. In still other embodiments, the nucleic acid encodes a gRNA, e.g., the first gRNA molecule, comprising a targeting domain that is 19 nucleotides in length. In still other embodiments, the nucleic acid encodes a gRNA, e.g., the first gRNA molecule, comprising a targeting domain that is 20 nucleotides in length. In still other embodiments, the nucleic acid encodes a gRNA, e.g., the first gRNA molecule, comprising a targeting domain that is 21 nucleotides in length. In still other embodiments, the nucleic acid encodes a gRNA, e.g., the first gRNA molecule, comprising a targeting domain that is 22 nucleotides in length. In still other embodiments, the nucleic acid encodes a gRNA, e.g., the first gRNA molecule, comprising a targeting domain that is 23 nucleotides in length. In still other embodiments, the nucleic acid encodes a gRNA, e.g., the first gRNA molecule, comprising a targeting domain that is 24 nucleotides in length. In still other embodiments, the nucleic acid encodes a gRNA, e.g., the first gRNA molecule, comprising a targeting domain that is 25 nucleotides in length. In still other embodiments, the nucleic acid encodes a gRNA, e.g., the first gRNA molecule, comprising a targeting domain that is 26 nucleotides in length.

In an embodiment, a nucleic acid encodes a gRNA comprising from 5' to 3': a targeting domain (comprising a "core domain", and optionally a "secondary domain"); a first complementarity domain; a linking domain; a second complementarity domain; a proximal domain; and a tail domain. In some embodiments, the proximal domain and tail domain are taken together as a single domain.

In an embodiment, a nucleic acid encodes a gRNA e.g., the first gRNA molecule, comprising a linking domain of no more than 25 nucleotides in length; a proximal and tail domain, that taken together, are at least 20 nucleotides in length; and a targeting domain of equal to or greater than 16, 17, 18, 19, 20, 21, 22, 23, 24, 25 or 26 nucleotides in length.

In an embodiment, a nucleic acid encodes a gRNA e.g., the first gRNA molecule, comprising a linking domain of no more than 25 nucleotides in length; a proximal and tail domain, that taken together, are at least 30 nucleotides in length; and a targeting domain of equal to or greater than 16, 17, 18, 19, 20, 21, 22, 23, 24, 25 or 26 nucleotides in length.

In an embodiment, a nucleic acid encodes a gRNA e.g., the first gRNA molecule, comprising a linking domain of no more than 25 nucleotides in length; a proximal and tail domain, that taken together, are at least 30 nucleotides in length; and a targeting domain of equal to or greater than 16, 17, 18, 19, 20, 21, 22, 23, 24, 25 or 26 nucleotides in length.

In an embodiment, a nucleic acid encodes a gRNA comprising e.g., the first gRNA molecule, a linking domain of no more than 25 nucleotides in length; a proximal and tail domain, that taken together, are at least 40 nucleotides in length; and a targeting domain of equal to or greater than 16, 17, 18, 19, 20, 21, 22, 23, 24, 25 or 26 nucleotides in length.

In an embodiment, a nucleic acid comprises (a) a sequence that encodes a gRNA molecule comprising a targeting domain that is complementary with a target domain in the CEP290 gene as disclosed herein, and further comprises (b) a sequence that encodes a Cas9 molecule.

The Cas9 molecule may be a nickase molecule, a enzymatically activating Cas9 (eaCas9) molecule, e.g., an eaCas9 molecule that forms a double strand break in a target nucleic acid and an eaCas9 molecule forms a single strand break in a target nucleic acid. In an embodiment, a single strand break is formed in the strand of the target nucleic acid to which the targeting domain of said gRNA is complementary. In another embodiment, a single strand break is formed in the strand of the target nucleic acid other than the strand to which the targeting domain of said gRNA is complementary.

In an embodiment, the eaCas9 molecule catalyzes a double strand break.

In some embodiments, the eaCas9 molecule comprises HNH-like domain cleavage activity but has no, or no significant, N-terminal RuvC-like domain cleavage activity. In other embodiments, the said eaCas9 molecule is an HNH-like domain nickase, e.g., the eaCas9 molecule comprises a mutation at D10, e.g., D10A. In other embodiments, the eaCas9 molecule comprises N-terminal RuvC-like domain cleavage activity but has no, or no significant, HNH-like domain cleavage activity. In another embodiment, the eaCas9 molecule is an N-terminal RuvC-like domain nickase, e.g., the eaCas9 molecule comprises a mutation at H840, e.g., H840A. In another embodiment, the eaCas9 molecule is an N-terminal RuvC-like domain nickase, e.g., the eaCas9 molecule comprises a mutation at H863, e.g., H863A.

A nucleic acid disclosed herein may comprise (a) a sequence that encodes a gRNA molecule comprising a targeting domain that is complementary with a target domain in the CEP290 gene as disclosed herein; and (b) a sequence that encodes a Cas9 molecule.

A nucleic acid disclosed herein may comprise (a) a sequence that encodes a gRNA molecule comprising a targeting domain that is complementary with a target domain in the CEP290 gene as disclosed herein; (b) a sequence that encodes a Cas9 molecule; and further comprises (c)(i) a sequence that encodes a second gRNA molecule described herein having a targeting domain that is complementary to a second target domain of the CEP290 gene, and optionally, (ii) a sequence that encodes a third gRNA molecule described herein having a targeting domain that is complementary to a third target domain of the CEP290 gene; and optionally, (iii) a sequence that encodes a fourth gRNA molecule described herein having a targeting domain that is complementary to a fourth target domain of the CEP290 gene.

In an embodiment, a nucleic acid encodes a second gRNA molecule comprising a targeting domain configured to provide a cleavage event, e.g., a double strand break or a single strand break, sufficiently close to a LCA10 target position in the CEP290 gene to allow alteration, e.g., alteration associated with NHEJ, of the LCA10 target position, either alone or in combination with the break positioned by said first gRNA molecule.

In an embodiment, a nucleic acid encodes a third gRNA molecule comprising a targeting domain configured to provide a cleavage event, e.g., a double strand break or a single strand break, sufficiently close to a LCA10 target position in the CEP290 gene to allow alteration, e.g., alteration associated with NHEJ, either alone or in combination with the break positioned by the first and/or second gRNA molecule.

In an embodiment, a nucleic acid encodes a fourth gRNA molecule comprising a targeting domain configured to provide a cleavage event, e.g., a double strand break or a single strand break, sufficiently close to a LCA10 target position in the CEP290 gene to allow alteration, e.g., alteration associated with NHEJ, either alone or in combination with the break positioned by the first gRNA molecule, the second gRNA molecule and/or the third gRNA molecule.

In an embodiment, a nucleic acid encodes a second gRNA molecule comprising a targeting domain configured to provide a cleavage event, e.g., a double strand break or a single strand break, in combination with the break position by said first gRNA molecule, sufficiently close to a LCA10 target position in the CEP290 gene to allow alteration, e.g., alteration associated with NHEJ, of the a LCA 10 target position in the CEP290 gene, either alone or in combination with the break positioned by said first gRNA molecule.

In an embodiment, a nucleic acid encodes a third gRNA molecule comprising a targeting domain configured to provide a cleavage event, e.g., a double strand break or a single strand break, in combination with the break position by said first and/or second gRNA molecule sufficiently close to a LCA10 target position in the CEP290 gene to allow alteration, e.g., alteration associated with NHEJ, either alone or in combination with the break positioned by the first and/or second gRNA molecule.

In an embodiment, a nucleic acid encodes a fourth gRNA molecule comprising a targeting domain configured to provide a cleavage event, e.g., a double strand break or a single strand break, in combination with the break positioned by the first gRNA molecule, the second gRNA molecule and/or the third gRNA molecule, sufficiently close to a LCA10 target position in the CEP290 gene to allow alteration, e.g., alteration associated with NHEJ, either alone or in combination with the break positioned by the first gRNA molecule, the second gRNA molecule and/or the third gRNA molecule.

In an embodiment, the nucleic acid encodes a second gRNA molecule. The second gRNA is selected to target the LCA10 target position. Optionally, the nucleic acid may encode a third gRNA, and further optionally, the nucleic acid may encode a fourth gRNA molecule.

In an embodiment, the nucleic acid encodes a second gRNA molecule comprising a targeting domain comprising a sequence that is the same as, or differs by no more than 1, 2, 3, 4, or 5 nucleotides from, a targeting domain sequence from one of Tables 2A-2D, Tables 3A-3C, Tables 4A-4D, Tables 5A-5D, Tables 6A-6B, Tables 7A-7D, Tables 8A-8D, Tables 9A-9E, Tables 10A-10B, or Table 11. In an embodiment, the nucleic acid encodes a second gRNA molecule comprising a targeting domain selected from those in Tables 2A-2D, Tables 3A-3C, Tables 4A-4D, Tables 5A-5D, Tables 6A-6B, Tables 7A-7D, Tables 8A-8D, Tables 9A-9E, Tables 10A-10B, or Table 11. In an embodiment, when a third or fourth gRNA molecule are present, the third and fourth gRNA molecules may independently comprise a targeting domain comprising a sequence that is the same as, or differs by no more than 1, 2, 3, 4, or 5 nucleotides from, a targeting domain sequence from one of Tables 2A-2D, Tables 3A-3C, Tables 4A-4D, Tables 5A-5D, Tables 6A-6B, Tables 7A-7D, Tables 8A-8D, Tables 9A-9E, Tables 10A-10B, or Table 11. In a further embodiment, when a third or fourth gRNA molecule are present, the third and fourth gRNA molecules may independently comprise a targeting domain selected from those in Tables 2A-2D, Tables 3A-3C, Tables 4A-4D, Tables 5A-5D, Tables 6A-6B, Tables 7A-7D, Tables 8A-8D, Tables 9A-9E, Tables 10A-10B, or Table 11.

In an embodiment, the nucleic acid encodes a second gRNA which is a modular gRNA, e.g., wherein one or more nucleic acid molecules encode a modular gRNA. In other embodiments, the nucleic acid encoding a second gRNA is a chimeric gRNA. In other embodiments, when a nucleic acid encodes a third or fourth gRNA, the third and fourth gRNA may be a modular gRNA or a chimeric gRNA. When multiple gRNAs are used, any combination of modular or chimeric gRNAs may be used.

A nucleic acid may encode a second, a third, and/or a fourth gRNA, each independently, comprising a targeting domain comprising 16 nucleotides or more in length. In an embodiment, the nucleic acid encodes a second gRNA comprising a targeting domain that is 16 nucleotides in length. In other embodiments, the nucleic acid encodes a second gRNA comprising a targeting domain that is 17 nucleotides in length. In still other embodiments, the nucleic acid encodes a second gRNA comprising a targeting domain that is 18 nucleotides in length. In still other embodiments, the nucleic acid encodes a second gRNA comprising a targeting domain that is 19 nucleotides in length. In still other embodiments, the nucleic acid encodes a second gRNA comprising a targeting domain that is 20 nucleotides in length. In still other embodiments, the nucleic acid encodes a second gRNA comprising a targeting domain that is 21 nucleotides in length. In still other embodiments, the nucleic acid encodes a second gRNA comprising a targeting domain that is 22 nucleotides in length. In still other embodiments, the nucleic acid encodes a second gRNA comprising a targeting domain that is 23 nucleotides in length. In still other embodiments, the nucleic acid encodes a second gRNA comprising a targeting domain that is 24 nucleotides in length. In still other embodiments, the nucleic acid encodes a second gRNA comprising a targeting domain that is 25 nucleotides in length. In still other embodiments, the nucleic acid encodes a second gRNA comprising a targeting domain that is 26 nucleotides in length.

In an embodiment, the targeting domain comprises 16 nucleotides.

In an embodiment, the targeting domain comprises 17 nucleotides.

In an embodiment, the targeting domain comprises 18 nucleotides.

In an embodiment, the targeting domain comprises 19 nucleotides.

In an embodiment, the targeting domain comprises 20 nucleotides.

In an embodiment, the targeting domain comprises 21 nucleotides.

In an embodiment, the targeting domain comprises 22 nucleotides.

In an embodiment, the targeting domain comprises 23 nucleotides.

In an embodiment, the targeting domain comprises 24 nucleotides.

In an embodiment, the targeting domain comprises 25 nucleotides.

In an embodiment, the targeting domain comprises 26 nucleotides.

In an embodiment, a nucleic acid encodes a second, a third, and/or a fourth gRNA, each independently, comprising from 5' to 3': a targeting domain (comprising a "core domain", and optionally a "secondary domain"); a first complementarity domain; a linking domain; a second complementarity domain; a proximal domain; and a tail domain. In some embodiments, the proximal domain and tail domain are taken together as a single domain.

In an embodiment, a nucleic acid encodes a second, a third, and/or a fourth gRNA, each independently, comprising a linking domain of no more than 25 nucleotides in length; a proximal and tail domain, that taken together, are at least 20 nucleotides in length; and a targeting domain of equal to or greater than 16, 17, 18, 19, 20, 21, 22, 23, 24, 25 or 26 nucleotides in length.

In an embodiment, a nucleic acid encodes a second, a third, and/or a fourth gRNA, each independently, comprising a linking domain of no more than 25 nucleotides in length; a proximal and tail domain, that taken together, are at least 30 nucleotides in length; and a targeting domain of equal to or greater than 16, 17, 18, 19, 20, 21, 22, 23, 24, 25 or 26 nucleotides in length.

In an embodiment, a nucleic acid encodes a second, a third, and/or a fourth gRNA, each independently, comprising a linking domain of no more than 25 nucleotides in length; a proximal and tail domain, that taken together, are at least 30 nucleotides in length; and a targeting domain of equal to or greater than 16, 17, 18, 19, 20, 21, 22, 23, 24, 25 or 26 nucleotides in length.

In an embodiment, a nucleic acid encodes a second, a third, and/or a fourth gRNA, each independently, comprising a linking domain of no more than 25 nucleotides in length; a proximal and tail domain, that taken together, are at least 40 nucleotides in length; and a targeting domain of equal to or greater than 16, 17, 18, 19, 20, 21, 22, 23, 24, 25 or 26 nucleotides in length.

In some embodiments, when the CEP290 gene is altered, e.g., by NHEJ, the nucleic acid encodes (a) a sequence that encodes a gRNA molecule comprising a targeting domain that is complementary with a target domain in the CEP290 gene as disclosed herein; (b) a sequence that encodes a Cas9 molecule; optionally, (c)(i) a sequence that encodes a second gRNA molecule described herein having a targeting domain that is complementary to a second target domain of the CEP290 gene, and further optionally, (ii) a sequence that encodes a third gRNA molecule described herein having a targeting domain that is complementary to a third target domain of the CEP290 gene; and still further optionally, (iii) a sequence that encodes a fourth gRNA molecule described herein having a targeting domain that is complementary to a fourth target domain of the CEP290 gene.

As described above, a nucleic acid may comprise (a) a sequence encoding a gRNA molecule comprising a targeting domain that is complementary with a target domain in the CEP290, and (b) a sequence encoding a Cas9 molecule. In some embodiments, (a) and (b) are present on the same nucleic acid molecule, e.g., the same vector, e.g., the same viral vector, e.g., the same adeno-associated virus (AAV) vector. In an embodiment, the nucleic acid molecule is an AAV vector, e.g., an AAV vector described herein. Exemplary AAV vectors that may be used in any of the described compositions and methods include an AAV1 vector, a modified AAV1 vector, an AAV2 vector, a modified AAV2 vector, an AAV3 vector, a modified AAV3 vector, an AAV4 vector, a modified AAV4 vector, an AAV5 vector, a modified AAV5 vector, an AAV6 vector, a modified AAV6 vector, an AAV7 vector, a modified AAV7 vector, an AAV8 vector, an AAV9 vector, an AAV.rh10 vector, a modified AAV.rh10 vector, an AAV.rh32/33 vector, a modified AAV.rh32/33 vector, an AAV.rh43 vector, a modified AAV.rh43 vector, an AAV.rh64R1 vector, and a modified AAV.rh64R1 vector.

In other embodiments, (a) is present on a first nucleic acid molecule, e.g. a first vector, e.g., a first viral vector, e.g., a first AAV vector; and (b) is present on a second nucleic acid molecule, e.g., a second vector, e.g., a second vector, e.g., a second AAV vector. The first and second nucleic acid molecules may be AAV vectors, e.g., the AAV vectors described herein.

In other embodiments, the nucleic acid may further comprise (c)(i) a sequence that encodes a second gRNA molecule as described herein. In some embodiments, the nucleic acid comprises (a), (b) and (c)(i). Each of (a) and (c)(i) may be present on the same nucleic acid molecule, e.g., the same vector, e.g., the same viral vector, e.g., the same adeno-associated virus (AAV) vector. In an embodiment, the nucleic acid molecule is an AAV vector, e.g., an AAV vectors described herein.

In other embodiments, (a) and (c)(i) are on different vectors. For example, (a) may be present on a first nucleic acid molecule, e.g. a first vector, e.g., a first viral vector, e.g., a first AAV vector; and (c)(i) may be present on a second nucleic acid molecule, e.g., a second vector, e.g., a second vector, e.g., a second AAV vector. In an embodiment, the first and second nucleic acid molecules are AAV vectors, e.g., the AAV vectors described herein.

In another embodiment, each of (a), (b), and (c)(i) are present on the same nucleic acid molecule, e.g., the same vector, e.g., the same viral vector, e.g., an AAV vector. In an embodiment, the nucleic acid molecule is an AAV vector. In an alternate embodiment, one of (a), (b), and (c)(i) is encoded on a first nucleic acid molecule, e.g., a first vector, e.g., a first viral vector, e.g., a first AAV vector; and a second and third of (a), (b), and (c)(i) is encoded on a second nucleic acid molecule, e.g., a second vector, e.g., a second vector, e.g., a second AAV vector. The first and second nucleic acid molecule may be AAV vectors, e.g., the AAV vectors described herein.

In an embodiment, (a) is present on a first nucleic acid molecule, e.g., a first vector, e.g., a first viral vector, a first AAV vector; and (b) and (c)(i) are present on a second nucleic acid molecule, e.g., a second vector, e.g., a second vector, e.g., a second AAV vector. The first and second nucleic acid molecule may be AAV vectors, e.g., the AAV vectors described herein.

In other embodiments, (b) is present on a first nucleic acid molecule, e.g., a first vector, e.g., a first viral vector, e.g., a first AAV vector; and (a) and (c)(i) are present on a second nucleic acid molecule, e.g., a second vector, e.g., a second vector, e.g., a second AAV vector. The first and second nucleic acid molecule may be AAV vectors, e.g., the AAV vectors described herein.

In other embodiments, (c)(i) is present on a first nucleic acid molecule, e.g., a first vector, e.g., a first viral vector, e.g., a first AAV vector; and (b) and (a) are present on a second nucleic acid molecule, e.g., a second vector, e.g., a second vector, e.g., a second AAV vector. The first and second nucleic acid molecule may be AAV vectors, e.g., the AAV vectors described herein.

In another embodiment, each of (a), (b) and (c)(i) are present on different nucleic acid molecules, e.g., different vectors, e.g., different viral vectors, e.g., different AAV vector. For example, (a) may be on a first nucleic acid molecule, (b) on a second nucleic acid molecule, and (c)(i) on a third nucleic acid molecule. The first, second and third nucleic acid molecule may be AAV vectors, e.g., the AAV vectors described herein.

In another embodiment, when a third and/or fourth gRNA molecule are present, each of (a), (b), (c)(i), (c) (ii) and (c)(iii) may be present on the same nucleic acid molecule, e.g., the same vector, e.g., the same viral vector, e.g., an AAV vector. In an embodiment, the nucleic acid molecule is an AAV vector, e.g., an AAV vector. In an alternate embodiment, each of (a), (b), (c)(i), (c)(ii) and (c)(iii) may be present on the different nucleic acid molecules, e.g., different vectors, e.g., the different viral vectors, e.g., different AAV vectors. In further embodiments, each of (a), (b), (c)(i), (c) (ii) and (c)(iii) may be present on more than one nucleic acid molecule, but fewer than five nucleic acid molecules, e.g., AAV vectors, e.g., the AAV vectors described herein.

The nucleic acids described herein may comprise a promoter operably linked to the sequence that encodes the gRNA molecule of (a), e.g., a promoter described herein, e.g., a promoter described in Table 20. The nucleic acid may further comprise a second promoter operably linked to the sequence that encodes the second, third and/or fourth gRNA molecule of (c), e.g., a promoter described herein. The promoter and second promoter differ from one another. In some embodiments, the promoter and second promoter are the same.

The nucleic acids described herein may further comprise a promoter operably linked to the sequence that encodes the Cas9 molecule of (b), e.g., a promoter described herein, e.g., a promoter described in Table 20.

In another aspect, disclosed herein is a composition comprising (a) a gRNA molecule comprising a targeting domain that is complementary with a target domain in the CEP290 gene, as described herein. The composition of (a) may further comprise (b) a Cas9 molecule, e.g., a Cas9 molecule as described herein. A composition of (a) and (b) may further comprise (c) a second, third and/or fourth gRNA molecule, e.g., a second, third and/or fourth gRNA molecule described herein.

In another aspect, methods and compositions discussed herein, provide for treating or delaying the onset or progression of LCA10 by altering the LCA10 target position in the CEP290 gene.

In another aspect, disclosed herein is a method of altering a cell, e.g., altering the structure, e.g., altering the sequence, of a target nucleic acid of a cell, comprising contacting said cell with: (a) a gRNA that targets the CEP290 gene, e.g., a gRNA as described herein; (b) a Cas9 molecule, e.g., a Cas9 molecule as described herein; and optionally, (c) a second, third and/or fourth gRNA that targets CEP290 gene, e.g., a gRNA as described herein.

In some embodiments, the method comprises contacting said cell with (a) and (b).

In some embodiments, the method comprises contacting said cell with (a), (b), and (c).

The gRNA of (a) may be selected from any of Tables 2A-2D, Tables 3A-3C, Tables 4A-4D, Tables 5A-5D, Tables 6A-6B, Tables 7A-7D, Tables 8A-8D, Tables 9A-9E, Tables 10A-10B, or Table 11, or a gRNA that differs by no more than 1, 2, 3, 4, or 5 nucleotides from, a targeting domain sequence from any of Tables 2A-2D, Tables 3A-3C, Tables 4A-4D, Tables 5A-5D, Tables 6A-6B, Tables 7A-7D, Tables 8A-8D, Tables 9A-9E, Tables 10A-10B, or Table 11. The gRNA of (c) may be selected from any of Tables 2A-2D, Tables 3A-3C, Tables 4A-4D, Tables 5A-5D, Tables 6A-6B, Tables 7A-7D, Tables 8A-8D, Tables 9A-9E, Tables 10A-10B, or Table 11, or a gRNA that differs by no more than 1, 2, 3, 4, or 5 nucleotides from, a targeting domain sequence from any of Tables 2A-2D, Tables 3A-3C, Tables 4A-4D, Tables 5A-5D, Tables 6A-6B, Tables 7A-7D, Tables 8A-8D, Tables 9A-9E, Tables 10A-10B, or Table 11.

In some embodiments, the method comprises contacting a cell from a subject suffering from or likely to develop LCA10. The cell may be from a subject having a mutation at a LCA10 target position.

In some embodiments, the cell being contacted in the disclosed method is a photoreceptor cell. The contacting may be performed ex vivo and the contacted cell may be returned to the subject's body after the contacting step. In other embodiments, the contacting step may be performed in vivo.

In some embodiments, the method of altering a cell as described herein comprises acquiring knowledge of the presence of a LCA10 target position in said cell, prior to the contacting step. Acquiring knowledge of the presence of a LCA10 target position in the cell may be by sequencing the CEP290 gene, or a portion of the CEP290 gene.

In some embodiments, the contacting step of the method comprises contacting the cell with a nucleic acid, e.g., a vector, e.g., an AAV vector, e.g., an AAV vector described herein, that expresses at least one of (a), (b), and (c). In some embodiments, the contacting step of the method comprises contacting the cell with a nucleic acid, e.g., a vector, e.g., an AAV vector, that expresses each of (a), (b), and (c). In another embodiment, the contacting step of the method comprises delivering to the cell a Cas9 molecule of (b) and a nucleic acid which encodes a gRNA (a) and optionally, a second gRNA (c)(i) (and further optionally, a third gRNA (c)(iv) and/or fourth gRNA (c)(iii)).

In an embodiment, contacting comprises contacting the cell with a nucleic acid, e.g., a vector, e.g., an AAV vector, e.g., an AAV1 vector, a modified AAV1 vector, an AAV2 vector, a modified AAV2 vector, an AAV3 vector, a modified AAV3 vector, an AAV4 vector, a modified AAV4 vector, an AAV5 vector, a modified AAV5 vector, an AAV6 vector, a modified AAV6 vector, an AAV7 vector, a modified AAV7 vector, an AAV8 vector, an AAV9 vector, an AAV.rh10 vector, a modified AAV.rh10 vector, an AAV.rh32/33 vector, a modified AAV.rh32/33 vector, an AAV.rh43 vector, a modified AAV.rh43 vector, an AAV.rh64R1 vector, and a modified AAV.rh64R1 vector, e.g., an AAV vector described herein.

In an embodiment, contacting comprises delivering to said cell said Cas9 molecule of (b), as a protein or an mRNA, and a nucleic acid which encodes and (a) and optionally (c).

In an embodiment, contacting comprises delivering to said cell said Cas9 molecule of (b), as a protein or an mRNA, said gRNA of (a), as an RNA, and optionally said second gRNA of (c), as an RNA.

In an embodiment, contacting comprises delivering to said cell said gRNA of (a) as an RNA, optionally said second gRNA of (c) as an RNA, and a nucleic acid that encodes the Cas9 molecule of (b).

In another aspect, disclosed herein is a method of treating, or preventing a subject suffering from developing, LCA10, e.g., by altering the structure, e.g., sequence, of a target nucleic acid of the subject, comprising contacting the subject (or a cell from the subject) with:

(a) a gRNA that targets the CEP290 gene, e.g., a gRNA disclosed herein;

(b) a Cas9 molecule, e.g., a Cas9 molecule disclosed herein; and optionally, (c)(i) a second gRNA that targets the CEP290 gene, e.g., a second gRNA disclosed herein, and further optionally, (c)(ii) a third gRNA, and still further optionally, (c)(iii) a fourth gRNA that target the CEP290, e.g., a third and fourth gRNA disclosed herein.

In some embodiments, contacting comprises contacting with (a) and (b).

In some embodiments, contacting comprises contacting with (a), (b), and (c)(i).

In some embodiments, contacting comprises contacting with (a), (b), (c)(i) and (c)(ii).

In some embodiments, contacting comprises contacting with (a), (b), (c)(i), (c)(ii) and (c)(iii).

The gRNA of (a) or (c) (e.g., (c)(i), (c)(ii), or (c)(iii)) may be independently selected from any of Tables 2A-2D, Tables 3A-3C, Tables 4A-4D, Tables 5A-5D, Tables 6A-6B, Tables 7A-7D, Tables 8A-8D, Tables 9A-9E, Tables 10A-10B, or Table 11, or a gRNA that differs by no more than 1, 2, 3, 4, or 5 nucleotides from, a targeting domain sequence from any of Tables 2A-2D, Tables 3A-3C, Tables 4A-4D, Tables 5A-5D, Tables 6A-6B, Tables 7A-7D, Tables 8A-8D, Tables 9A-9E, Tables 10A-10B, or Table 11.

In an embodiment, said subject is suffering from, or likely to develop LCA10. In an embodiment, said subject has a mutation at a LCA10 target position.

In an embodiment, the method comprises acquiring knowledge of the presence of a mutation at a LCA10 target position in said subject.

In an embodiment, the method comprises acquiring knowledge of the presence of a mutation a LCA10 target position in said subject by sequencing the CEP290 gene or a portion of the CEP290 gene.

In an embodiment, the method comprises altering the LCA10 target position in the CEP290 gene.

In an embodiment, a cell of said subject is contacted ex vivo with (a), (b) and optionally (c). In an embodiment, said cell is returned to the subject's body.

In an embodiment, the method comprises introducing a cell into said subject's body, wherein said cell subject was contacted ex vivo with (a), (b) and optionally (c).

In an embodiment, the method comprises said contacting is performed in vivo. In an embodiment, the method comprises sub-retinal delivery. In an embodiment, contacting comprises sub-retinal injection. In an embodiment, contacting comprises intra-vitreal injection.

In an embodiment, contacting comprises contacting the subject with a nucleic acid, e.g., a vector, e.g., an AAV vector described herein, e.g., a nucleic acid that encodes at least one of (a), (b), and optionally (c).

In an embodiment, contacting comprises delivering to said subject said Cas9 molecule of (b), as a protein or mRNA, and a nucleic acid which encodes and (a) and optionally (c).

In an embodiment, contacting comprises delivering to said subject said Cas9 molecule of (b), as a protein or mRNA, said gRNA of (a), as an RNA, and optionally said second gRNA of (c), as an RNA.

In an embodiment, contacting comprises delivering to said subject said gRNA of (a), as an RNA, optionally said second gRNA of (c), as an RNA, and a nucleic acid that encodes the Cas9 molecule of (b).

In another aspect, disclosed herein is a reaction mixture comprising a gRNA, a nucleic acid, or a composition described herein, and a cell, e.g., a cell from a subject having, or likely to develop LCA10, or a subject having a mutation at a LCA10 target position.

In another aspect, disclosed herein is a kit comprising, (a) a gRNA molecule described herein, or a nucleic acid that encodes said gRNA, and one or more of the following:

(b) a Cas9 molecule, e.g., a Cas9 molecule described herein, or a nucleic acid or mRNA that encodes the Cas9;

(c)(i) a second gRNA molecule, e.g., a second gRNA molecule described herein or a nucleic acid that encodes (c)(i);

(c)(ii) a third gRNA molecule, e.g., a second gRNA molecule described herein or a nucleic acid that encodes (c)(ii); or (c)(iii) a fourth gRNA molecule, e.g., a second gRNA molecule described herein or a nucleic acid that encodes (c)(iii).

In an embodiment, the kit comprises nucleic acid, e.g., an AAV vector, e.g., an AAV vector described herein, that encodes one or more of (a), (b), (c)(i), (c)(ii), and (c)(iii). In an embodiment, the kit further comprises a governing gRNA molecule, or a nucleic acid that encodes a governing gRNA molecule.

In yet another aspect, disclosed herein is a gRNA molecule, e.g., a gRNA molecule described herein, for use in treating LCA10 in a subject, e.g., in accordance with a method of treating LCA10 as described herein.

In an embodiment, the gRNA molecule in used in combination with a Cas9 molecule, e.g., a Cas9 molecule described herein. Additionally or alternatively, in an embodiment, the gRNA molecule is used in combination with a second, third and/or fourth gRNA molecule, e.g., a second, third and/or fourth gRNA molecule described herein.

In still another aspect, disclosed herein is use of a gRNA molecule, e.g., a gRNA molecule described herein, in the manufacture of a medicament for treating LCA10 in a subject, e.g., in accordance with a method of treating LCA10 as described herein.

In an embodiment, the medicament comprises a Cas9 molecule, e.g., a Cas9 molecule described herein. Additionally or alternatively, in an embodiment, the medicament comprises a second, third and/or fourth gRNA molecule, e.g., a second, third and/or fourth gRNA molecule described herein.

In one aspect, disclosed herein is a recombinant adenovirus-associated virus (AAV) genome comprising the components set forth in FIG. 33:

wherein the left ITR component comprises, or consists of, a nucleotide sequence that is the same as, differs by no more than 1, 2, 3, 4, 5, 6, 7, 8, 9, or 10 nucleotides from, or has at least 90%, 92%, 94%, 96%, 98%, or 99% homology with, any of the left ITR nucleotide sequences disclosed in Table 25, or any of the nucleotide sequences of SEQ ID NOs: 407-415;

wherein the spacer 1 component comprises, or consists of, a nucleotide sequence having 0 to 150 nucleotides in length, e.g., SEQ ID NO: 416;

wherein the PIII promoter component comprises, or consists of, an RNA polymerase III promoter sequence;

wherein the gRNA component comprises a targeting domain and a scaffold domain,
  wherein the targeting domain is 16-26 nucleotides in length, and comprises, or consists of, a targeting domain sequence disclosed herein, e.g., in any of Tables 2A-2D, Tables 3A-3C, Tables 4A-4D, Tables 5A-5D, Tables 6A-6B, Tables 7A-7D, Tables 8A-8D, Tables 9A-9E, Tables 10A-10B, or Table 11; and
  wherein the scaffold domain (also referred to as a tracr domain in FIGS. 20A-25F) comprises, or consists of, a nucleotide sequence that is the same as, differs by no more than 1, 2, 3, 4, or 5 nucleotides from, or has at least has at least 90%, 92%, 94%, 96%, 98%, or 99% homology with, a nucleotide sequence of SEQ ID NO: 418;

wherein the spacer 2 component comprises, or consists of, a nucleotide sequence having 0 to 150 nucleotides in length e.g., SEQ ID NO: 419;

wherein the PII promoter component comprises, or consists of, a polymerase II promoter sequence, e.g., a constitutive or tissue specific promoter, e.g., a promoter disclosed in Table 20;

wherein the N-ter NLS component comprises, or consists of, a nucleotide sequence that is the same as, differs by no more than 1, 2, 3, 4, or 5 nucleotides from, or has at least has at least 90%, 92%, 94%, 96%, 98%, or 99% homology with, the nucleotide sequence of SEQ ID NO: 420 or a nucleotide sequence that encodes the amino acid sequence of SEQ ID NO: 434;

wherein the Cas9 component comprises, or consists of, a nucleotide sequence that is the same as, differs by no more than 1, 2, 3, 4, 5, 6, 7, 8, 9, or 10 nucleotides from, or has at least 90%, 92%, 94%, 96%, 98%, or 99% homology with, the nucleotide sequence of SEQ ID NO: 421 or a nucleotide sequence that encodes the amino acid sequence of SEQ ID NO: 26;

wherein the C-ter NLS component comprises, or consists of, a nucleotide sequence that is the same as, differs by no more than 1, 2, 3, 4, or 5 nucleotides from, or has at least has at least 90%, 92%, 94%, 96%, 98%, or 99% homology with, the nucleotide sequence of SEQ ID NO: 422 or a nucleotide sequence that encodes the amino acid sequence of SEQ ID NO: 434;

wherein the poly(A) signal component comprises, or consists of, a nucleotide sequence that is the same as, differs by no more than 1, 2, 3, 4, 5, 6, 7, 8, 9, or 10 nucleotides from, or has at least has at least 90%, 92%, 94%, 96%, 98%, or 99% homology with, any of the nucleotide sequences disclosed in Table 27, or any of the nucleotide sequences of SEQ ID NOs: 424, 455 or 456;

wherein the spacer 3 component comprises, or consists of, a nucleotide sequence having 0 to 150 nucleotides in length, e.g., SEQ ID NO: 425; and wherein the right ITR component comprises, or consists of, a nucleotide sequence that is the same as, differs by no more than 1, 2, 3, 4, 5, 6, 7, 8, 9, or 10 nucleotides from, or has at least has at least 90%, 92%, 94%, 96%, 98%, or 99% homology with, any of the right ITR nucleotide sequences disclosed in Table 25, or any of the nucleotide sequences of SEQ ID NOs: 436-444.

In an embodiment, the left ITR component comprises, or consists of, a nucleotide sequence that is the same as any of the nucleotide sequences of SEQ ID NOs: 407-415.

In an embodiment, the spacer 1 component comprises, or consists of, a nucleotide sequence that is the same as the nucleotide sequence of SEQ ID NO: 416.

In an embodiment, the PIII promoter component is a U6 promoter component.

In an embodiment, the U6 promoter component comprises, or consists of, a nucleotide sequence that is the same as, differs by no more than 1, 2, 3, 4, 5, 6, 7, 8, 9, or 10 nucleotides from, or has at least has at least 90%, 92%, 94%, 96%, 98%, or 99% homology with, the nucleotide sequence of SEQ ID NO: 417;

In an embodiment, the U6 promoter component comprises, or consists of, a nucleotide sequence that is the same as the nucleotide sequence of SEQ ID NO: 417.

In an embodiment, the PIII promoter component is an H1 promoter component that comprises an H1 promoter sequence.

In an embodiment, the PIII promoter component is a tRNA promoter component that comprises a tRNA promoter sequence.

In an embodiment, the targeting domain comprises, or consists of, a nucleotide sequence that is the same as a nucleotide sequence selected from Table 11.

In an embodiment, the gRNA scaffold domain comprises, or consists of, a nucleotide sequence that is the same as the nucleotide sequence of SEQ ID NO: 418.

In an embodiment, the spacer 2 component comprises, or consists of, a nucleotide sequence that is the same as the nucleotide sequence of SEQ ID NO: 419; In an embodiment, the PII promoter component is a CMV promoter component, and comprises, or consists of, a nucleotide sequence that is the same as, differs by no more than 1, 2, 3, 4, 5, 6, 7, 8, 9, or 10 nucleotides from, or has at least has at least 90%, 92%, 94%, 96%, 98%, or 99% homology with, the nucleotide sequence of SEQ ID NO: 401. In an embodiment, the PII promoter comprises, or consists of, a nucleotide sequence that is the same as the nucleotide sequence of SEQ ID NO: 401.

In an embodiment, the PII promoter component is an EFS promoter component, and comprises, or consists of, a nucleotide sequence that is the same as, differs by no more than 1, 2, 3, 4, 5, 6, 7, 8, 9, or 10 nucleotides from, or has at least has at least 90%, 92%, 94%, 96%, 98%, or 99% homology with, the nucleotide sequence of SEQ ID NO: 402. In an embodiment, the PII promoter comprises, or consists of, a nucleotide sequence that is the same as the nucleotide sequence of SEQ ID NO: 402.

In an embodiment, the PII promoter component is a GRK1 promoter (e.g., a human GRK1 promoter) component, and comprises, or consists of, a nucleotide sequence that is the same as, differs by no more than 1, 2, 3, 4, 5, 6, 7, 8, 9, or 10 nucleotides from, or has at least has at least 90%, 92%, 94%, 96%, 98%, or 99% homology with, the nucleotide sequence of SEQ ID NO: 403. In an embodiment, the PII promoter comprises, or consists of, a nucleotide sequence that is the same as the nucleotide sequence of SEQ ID NO: 403.

In an embodiment, the PII promoter component is a CRX promoter (e.g., a human CRX promoter) component, and comprises, or consists of, a nucleotide sequence that is the same as, differs by no more than 1, 2, 3, 4, 5, 6, 7, 8, 9, or 10 nucleotides from, or has at least has at least 90%, 92%, 94%, 96%, 98%, or 99% homology with, the nucleotide sequence of SEQ ID NO: 404. In an embodiment, the PII promoter comprises, or consists of, a nucleotide sequence that is the same as the nucleotide sequence of SEQ ID NO: 404.

In an embodiment, the PII promoter component is an NRL promoter (e.g., a human NRL promoter) component, and comprises, or consists of, a nucleotide sequence that is the same as, differs by no more than 1, 2, 3, 4, 5, 6, 7, 8, 9, or 10 nucleotides from, or has at least has at least 90%, 92%, 94%, 96%, 98%, or 99% homology with, the nucleotide sequence of SEQ ID NO: 405. In an embodiment, the PII promoter comprises, or consists of, a nucleotide sequence that is the same as the nucleotide sequence of SEQ ID NO: 405.

In an embodiment, the PII promoter component is an RCVRN promoter (e.g., a human RCVRN promoter) component, and comprises, or consists of, a nucleotide sequence that is the same as, differs by no more than 1, 2, 3, 4, 5, 6, 7, 8, 9, or 10 nucleotides from, or has at least has at least 90%, 92%, 94%, 96%, 98%, or 99% homology with, the nucleotide sequence of SEQ ID NO: 406. In an embodiment, the PII promoter comprises, or consists of, a nucleotide sequence that is the same as the nucleotide sequence of SEQ ID NO: 406.

In an embodiment, the N-ter NLS component comprises, or consists of, a nucleotide sequence that is the same as the nucleotide sequence of SEQ ID NO: 420 or a nucleotide sequence encoding the amino acid sequence of SEQ ID NO: 434.

In an embodiment, the Cas9 component comprises, or consists of, a nucleotide sequence that is the same as the nucleotide sequence of SEQ ID NO: 421 or a nucleotide sequence encoding the amino acid sequence of SEQ ID NO: 26.

In an embodiment, the C-ter NLS component comprises, or consists of, a nucleotide sequence that is the same as the nucleotide sequence of SEQ ID NO: 422 or a nucleotide sequence encoding the amino acid sequence of SEQ ID NO: 434.

In an embodiment, the poly(A) signal component comprises, or consists of, a nucleotide sequence that is the same as any of the nucleotide sequences disclosed in Table 27, or any of the nucleotide sequences of SEQ ID NOs: 424, 455 or 456. In an embodiment, the poly(A) signal component comprises, or consists of, a nucleotide sequence that is the same as the nucleotide sequence of SEQ ID NO: 424.

In an embodiment, the spacer 3 component comprises, or consists of, a nucleotide sequence that is the same as the nucleotide sequence of SEQ ID NO: 425.

In an embodiment, the right ITR component comprises, or consists of, a nucleotide sequence that is the same as any of the nucleotide sequences of SEQ ID NOs: 436-444.

In an embodiment, the recombinant AAV genome further comprises a second gRNA component comprising a targeting domain and a scaffold domain, wherein the targeting domain consists of a targeting domain sequence disclosed herein, in any of Tables 2A-2D, Tables 3A-3C, Tables 4A-4D, Tables 5A-5D, Tables 6A-6B, Tables 7A-7D, Tables 8A-8D, Tables 9A-9E, Tables 10A-10B, or Table 11; and wherein the scaffold domain (also referred to as a tracr domain in FIGS. 20A-25F) comprises, or consists of, a nucleotide sequence that is the same as, or differs by no more than 1, 2, 3, 4, or 5 nucleotides from, or has at least has at least 90%, 92%, 94%, 96%, 98%, or 99% homology with, the nucleotide sequence of SEQ ID NO: 418.

In an embodiment, the targeting domain of the second gRNA component comprises, or consists of, a nucleotide sequence that is the same as a nucleotide sequence selected from Table 11. In an embodiment, the second gRNA component is between the first gRNA component and the spacer 2 component.

In an embodiment, the second gRNA component has the same nucleotide sequence as the first gRNA component. In another embodiment, the second gRNA component has a nucleotide sequence that is different from the second gRNA component.

In an embodiment, the recombinant AAV genome further comprises a second PIII promoter component that comprises, or consists of, an RNA polymerase III promoter sequence;

In an embodiment, the recombinant AAV genome further comprises a second PIII promoter component (e.g., a second U6 promoter component) between the first gRNA component and the second gRNA component.

In an embodiment, the second PIII promoter component (e.g., the second U6 promoter component) has the same nucleotide sequence as the first PIII promoter component (e.g., the first U6 promoter component). In another embodiment, the second PIII promoter component (e.g., the second U6 promoter component) has a nucleotide sequence that is different from the first PIII promoter component (e.g. the first U6 promoter component).

In an embodiment, the PIII promoter component is an H1 promoter component that comprises an H1 promoter sequence.

In an embodiment, the PIII promoter component is a tRNA promoter component that comprises a tRNA promoter sequence.

In an embodiment, the recombinant AAV genome further comprises a spacer 4 component between the first gRNA component and the second PIII promoter component (e.g., the second U6 promoter component). In an embodiment, the spacer 4 component comprises, or consists of, a nucleotide sequence having 0 to 150 nucleotides in length, e.g., SEQ ID NO: 427. In an embodiment, the spacer 4 component comprises, or consists of, a nucleotide sequence that is the same as the nucleotide sequence of SEQ ID NO: 427.

In an embodiment, the recombinant AAV genome comprises the components set forth in FIG. 34.

In an embodiment, the recombinant AAV genome further comprises an affinity tag component (e.g., 3×FLAG component), wherein the affinity tag component (e.g., 3×FLAG component) comprises, or consists of, a nucleotide sequence that is the same as, differs by no more than 1, 2, 3, 4, or 5 nucleotides from, or has at least has at least 90%, 92%, 94%, 96%, 98%, or 99% homology with, the nucleotides sequence of SEQ ID NO: 423, or a nucleotide sequence encoding any of the amino acid sequences disclosed in Table 26 or any of the amino acid sequences of SEQ ID NOs: 426 or 451-454.

In an embodiment, the affinity tag component (e.g., 3×FLAG component) is between the C-ter NLS component and the poly(A) signal component. In an embodiment, the an affinity tag component (e.g., 3×FLAG component) comprises, or consists of, a nucleotide sequence that is the same as, the nucleotides sequence of SEQ ID NO: 423, or a nucleotide sequence encoding any of the amino acid sequences of SEQ ID NOs: 426 or 451-454.

In an embodiment, the recombinant AAV genome comprises the nucleotide sequences of SEQ ID NOs: 408, 417, 418, 401, 420, 421, 422, 424, and 437.

In an embodiment, the recombinant AAV genome comprises the nucleotide sequences of SEQ ID NOs: 408, 417, 418, 402, 420, 421, 422, 424, and 437.

In an embodiment, the recombinant AAV genome comprises the nucleotide sequences of SEQ ID NOs: 408, 417, 418, 403, 420, 421, 422, 424, and 437.

In an embodiment, the recombinant AAV genome comprises the nucleotide sequences of SEQ ID NOs: 408, 417, 418, 404, 420, 421, 422, 424, and 437.

In an embodiment, the recombinant AAV genome comprises the nucleotide sequences of SEQ ID NOs: 408, 417, 418, 405, 420, 421, 422, 424, and 437.

In an embodiment, the recombinant AAV genome comprises the nucleotide sequences of SEQ ID NOs: 408, 417, 418, 406, 420, 421, 422, 424, and 437.

In an embodiment, the recombinant AAV genome further comprises SEQ ID NOs: 416, 419, and 425, and, optionally, SEQ ID NO 427.

In an embodiment, the recombinant AAV genome further comprises the nucleotide sequence of SEQ ID NO: 423.

In an embodiment, the recombinant AAV genome comprises or consists of one or more (e.g., 2, 3, 4, 5, 6, 7, 8, 9, 10, 11, 12 or all) of the component sequences shown in FIG. 19A-19G, 20A-20F, 21A-21F, 22A-22F, 23A-23F, or 24A-24F, Tables 20 or 25-27, or any of the nucleotide sequences of SEQ ID NOs: 428-433 or 436-444.

In another aspect, disclosed herein is a recombinant adenovirus-associated virus (AAV) genome comprising the components set forth in FIG. 35:

wherein the left ITR component comprises, or consists of, a nucleotide sequence that is the same as, or differs by no more than 1, 2, 3, 4, 5, 6, 7, 8, 9, or 10 nucleotides from, or has at least 90%, 92%, 94%, 96%, 98%, or 99% homology with, any of the left ITR nucleotide sequences disclosed in Table 25, or any of the nucleotide sequences of SEQ ID NOs: 407-415;

wherein the spacer 1 component comprises, or consists of, a nucleotide sequence having 0 to 150 nucleotides in length, e.g., SEQ ID NO: 416;

wherein the first PIII promoter component (e.g., a first U6 promoter component) comprises, or consists of, a nucleotide sequence that is the same as, differs by no more than 1, 2, 3, 4, 5, 6, 7, 8, 9, or 10 nucleotides from, or has at least has at least 90%, 92%, 94%, 96%, 98%, or 99% homology with, the nucleotide sequence of SEQ ID NO: 417;

wherein the first gRNA component comprises a targeting domain and a scaffold domain,
    wherein the targeting domain is 16-26 nucleotides in length, and comprises, or consists of, a targeting domain sequence disclosed herein, e.g., in any of Tables 2A-2D, Tables 3A-3C, Tables 4A-4D, Tables 5A-5D, Tables 6A-6B, Tables 7A-7D, Tables 8A-8D, Tables 9A-9E, Tables 10A-10B, or Table 11; and
    wherein the scaffold domain (also referred to herein as a tracr domain in FIGS. 19A-24F) comprises, or consists of, a nucleotide sequence that is the same as, or differs by no more than 1, 2, 3, 4, or 5 nucleotides from, or has at least has at least 90%, 92%, 94%, 96%, 98%, or 99% homology with, the nucleotide sequence of SEQ ID NO: 418;

wherein the spacer 4 component comprises, or consists of, a nucleotide sequence having 0 to 150 nucleotides in length, e.g., SEQ ID NO: 427.

wherein the second gRNA component comprises a targeting domain and a scaffold domain,
    wherein the targeting domain of the second gRNA component is 16-26 nucleotides in length and comprises, or consists of, a targeting domain sequence disclosed herein, e.g., in any of Tables 2A-2D, Tables 3A-3C, Tables 4A-4D, Tables 5A-5D, Tables 6A-6B, Tables 7A-7D, Tables 8A-8D, Tables 9A-9E, Tables 10A-10B, or Table 11; and wherein the scaffold domain (also referred to as a tracr domain in FIGS. 19A-24F) of the second gRNA component comprises, or consists of, a nucleotide sequence that is the same as, or differs by no more than 1, 2, 3, 4, or 5 nucleotides from, or has at least has at least 90%, 92%, 94%, 96%, 98%, or 99% homology with, the nucleotide sequence of SEQ ID NO: 418.

wherein the spacer 2 component comprises, or consists of, a nucleotide sequence having 0 to 150 nucleotides in length e.g., SEQ ID NO: 419;

wherein the PII promoter component comprises, or consists of, a polymerase II promoter sequence, e.g., a constitutive or tissue specific promoter, e.g., a promoter disclosed in Table 20;

wherein the N-ter NLS component comprises, or consists of, a nucleotide sequence that is the same as, differs by no more than 1, 2, 3, 4, or 5 nucleotides from, or has at least has at least 90%, 92%, 94%, 96%, 98%, or 99% homology with, the nucleotide sequence of SEQ ID NO: 420 or a nucleotide sequence that encodes the amino acid sequence of SEQ ID NO: 434;

wherein the Cas9 component comprises, or consists of, a nucleotide sequence that is the same as, differs by no more than 1, 2, 3, 4, 5, 6, 7, 8, 9, or 10 nucleotides from, or has at least 90%, 92%, 94%, 96%, 98%, or 99% homology with, the nucleotide sequence of SEQ ID NO: 421 or a nucleotide sequence that encodes the amino acid sequence of SEQ ID NO: 26;

wherein the C-ter NLS component comprises, or consists of, a nucleotide sequence that is the same as, differs by no more than 1, 2, 3, 4, or 5 nucleotides from, or has at least has at least 90%, 92%, 94%, 96%, 98%, or 99% homology with, the nucleotide sequence of SEQ ID NO: 422 or a nucleotide sequence that encodes the amino acid sequence of SEQ ID NO: 434;

wherein the poly(A) signal component comprises, or consists of, a nucleotide sequence that is the same as, differs by no more than 1, 2, 3, 4, 5, 6, 7, 8, 9, or 10 nucleotides from, or has at least has at least 90%, 92%, 94%, 96%, 98%, or 99% homology with, any of the nucleotide sequences disclosed in Table 27, or any of the nucleotide sequence of SEQ ID NO: 424, 455 or 456;

wherein the spacer 3 component comprises, or consists of, a nucleotide sequence having 0 to 150 nucleotides in length, e.g., SEQ ID NO: 425; and wherein the right ITR component comprises, or consists of, a nucleotide sequence that is the same as, or differs by no more than 1, 2, 3, 4, 5, 6, 7, 8, 9, or 10 nucleotides from, or has at least has at least 90%, 92%, 94%, 96%, 98%, or 99% homology with, any of the right ITR nucleotide sequences disclosed in Table 25, or SEQ ID NOs: 436-444.

In an embodiment, the left ITR component comprises, or consists of, a nucleotide sequence that is the same as any of the nucleotide sequences of SEQ ID NOs: 407-415.

In an embodiment, the spacer 1 component comprises, or consists of, a nucleotide sequence that is the same as the nucleotide sequence of SEQ ID NO: 416.

In an embodiment, the first PIII promoter component (e.g., the first U6 promoter component) comprises, or consists of, a nucleotide sequence that is the same as the nucleotide sequence of SEQ ID NO: 417.

In an embodiment, the first PIII promoter is an H1 promoter component that comprises an H1 promoter sequence. In another embodiment, the first PIII promoter is a tRNA promoter component that comprises a tRNA promoter sequence.

In an embodiment, the targeting domain of the first gRNA component comprises, or consists of, a nucleotide sequence that is the same as a nucleotide sequence selected from Table 11.

In an embodiment, the gRNA scaffold domain of the first gRNA component comprises, or consists of, a nucleotide sequence that is the same as the nucleotide sequence of SEQ ID NO: 418.

In an embodiment, the spacer 4 component comprises, or consists of, a nucleotide sequence that is the same as the nucleotide sequence of SEQ ID NO: 427.

In an embodiment, the second PIII promoter component (e.g., the first U6 promoter component) has the same nucleotide sequence as the first PIII promoter component (e.g., the first U6 promoter component). In another embodiment, the second PIII promoter component (e.g., the second U6 promoter component) has a nucleotide sequence that is different from the first PIII promoter component (e.g., the first U6 promoter component).

In an embodiment, the second PIII promoter is an H1 promoter component that comprises an H1 promoter sequence. In another embodiment, the second PIII promoter is a tRNA promoter component that comprises a tRNA promoter sequence.

In an embodiment, the targeting domain of the second gRNA component comprises, or consists of, a nucleotide sequence that is the same as a nucleotide sequence selected from Table 11.

In an embodiment, the second gRNA component has the same nucleotide sequence as the first gRNA component. In another embodiment, the second gRNA component has a nucleotide sequence that is different from the second gRNA component.

In an embodiment, the spacer 2 component comprises, or consists of, a nucleotide sequence having 0 to 150 nucleotides in length e.g., SEQ ID NO: 419;

In an embodiment, the PII promoter component is a CMV promoter component, and comprises, or consists of, a nucleotide sequence that is the same as, differs by no more than 1, 2, 3, 4, 5, 6, 7, 8, 9, or 10 nucleotides from, or has at least has at least 90%, 92%, 94%, 96%, 98%, or 99% homology with, the nucleotide sequence of SEQ ID NO: 401. In an embodiment, the PII promoter comprises, or consists of, a nucleotide sequence that is the same as the nucleotide sequence of SEQ ID NO: 401.

In an embodiment, the PII promoter component is an EFS promoter component, and comprises, or consists of, a nucleotide sequence that is the same as, differs by no more than 1, 2, 3, 4, 5, 6, 7, 8, 9, or 10 nucleotides from, or has at least has at least 90%, 92%, 94%, 96%, 98%, or 99% homology with, the nucleotide sequence of SEQ ID NO: 402. In an embodiment, the PII promoter comprises, or consists of, a nucleotide sequence that is the same as the nucleotide sequence of SEQ ID NO: 402.

In an embodiment, the PII promoter component is a GRK1 promoter (e.g., a human GRK1 promoter) component, and comprises, or consists of, a nucleotide sequence that is the same as, differs by no more than 1, 2, 3, 4, 5, 6, 7, 8, 9, or 10 nucleotides from, or has at least has at least 90%, 92%, 94%, 96%, 98%, or 99% homology with, the nucleotide sequence of SEQ ID NO: 403. In an embodiment, the PII promoter comprises, or consists of, a nucleotide sequence that is the same as the nucleotide sequence of SEQ ID NO: 403.

In an embodiment, the PII promoter component is a CRX promoter (e.g., a human CRX promoter) component, and comprises, or consists of, a nucleotide sequence that is the same as, differs by no more than 1, 2, 3, 4, 5, 6, 7, 8, 9, or 10 nucleotides from, or has at least has at least 90%, 92%, 94%, 96%, 98%, or 99% homology with, the nucleotide sequence of SEQ ID NO: 404. In an embodiment, the PII promoter comprises, or consists of, a nucleotide sequence that is the same as the nucleotide sequence of SEQ ID NO: 404.

In an embodiment, the PII promoter component is an NRL promoter (e.g., a human NRL promoter) component, and comprises, or consists of, a nucleotide sequence that is the same as, differs by no more than 1, 2, 3, 4, 5, 6, 7, 8, 9, or 10 nucleotides from, or has at least has at least 90%, 92%, 94%, 96%, 98%, or 99% homology with, the nucleotide sequence of SEQ ID NO: 405. In an embodiment, the PII promoter comprises, or consists of, a nucleotide sequence that is the same as the nucleotide sequence of SEQ ID NO: 405.

In an embodiment, the PII promoter component is an RCVRN promoter (e.g., a human RCVRN promoter) component, and comprises, or consists of, a nucleotide sequence that is the same as, differs by no more than 1, 2, 3, 4, 5, 6, 7, 8, 9, or 10 nucleotides from, or has at least has at least 90%, 92%, 94%, 96%, 98%, or 99% homology with, the nucleotide sequence of SEQ ID NO: 406. In an embodiment, the PII promoter comprises, or consists of, a nucleotide sequence that is the same as the nucleotide sequence of SEQ ID NO: 406.

In an embodiment, the N-ter NLS component comprises, or consists of, a nucleotide sequence that is the same as the nucleotide sequence of SEQ ID NO: 420 or a nucleotide sequence encoding the amino acid sequence of SEQ ID NO: 434.

In an embodiment, the Cas9 component comprises, or consists of, a nucleotide sequence that is the same as the nucleotide sequence of SEQ ID NO: 421 or a nucleotide sequence encoding the amino acid sequence of SEQ ID NO: 26.

In an embodiment, the C-ter NLS component comprises, or consists of, a nucleotide sequence that is the same as the nucleotide sequence of SEQ ID NO: 422 or a nucleotide sequence encoding the amino acid sequence of SEQ ID NO: 434.

In an embodiment, the poly(A) signal component comprises, or consists of, a nucleotide sequence that is the same as any of the nucleotide sequences disclosed in Table 27, or any of the nucleotide sequences of SEQ ID NOs: 424, 455 or 456. In an embodiment, the poly(A) signal component comprises, or consists of, a nucleotide sequence that is the same as the nucleotide sequence of SEQ ID NO: 424.

In an embodiment, the spacer 3 component comprises, or consists of, a nucleotide sequence that is the same as the nucleotide sequence of SEQ ID NO: 425.

In an embodiment, the right ITR component comprises, or consists of, a nucleotide sequence that is the same as any of the nucleotide sequences disclosed in Table 25, or any of the nucleotide sequences of SEQ ID NOs: 436-444.

In an embodiment, the recombinant AAV genome further comprises an affinity tag component (e.g., a 3×FLAG component). In an embodiment, the affinity tag component (e.g., the 3×FLAG component) comprises, or consists of, a nucleotide sequence that is the same as, differs by no more than 1, 2, 3, 4, or 5 nucleotides from, or has at least has at least 90%, 92%, 94%, 96%, 98%, or 99% homology with, the nucleotide sequence of SEQ ID NO: 423, or a nucleotide sequence encoding any of the amino acid sequences disclosed in Table 26 or any of the amino acid sequences of SEQ ID NO: 426 or 451-454.

In an embodiment, the affinity tag component (e.g., the 3×FLAG component) is between the C-ter NLS component and the poly(A) signal component. In an embodiment, the affinity tag component (e.g., the 3×FLAG component) comprises, or consists of, a nucleotide sequence that is the same as, the nucleotide sequence of SEQ ID NO: 423 or a nucleotide sequence encoding the amino acid sequence of SEQ ID NO: 426.

In an embodiment, the recombinant AAV genome comprises the nucleotide sequences of SEQ ID NOs: 408, 417, 418, 401, 420, 421, 422, 424, and 437.

In an embodiment, the recombinant AAV genome comprises the nucleotide sequences of SEQ ID NOs: 408, 417, 418, 402, 420, 421, 422, 424, and 437.

In an embodiment, the recombinant AAV genome comprises the nucleotide sequences of SEQ ID NOs: 408, 417, 418, 403, 420, 421, 422, 424, and 437.

In an embodiment, the recombinant AAV genome comprises the nucleotide sequences of SEQ ID NOs: 408, 417, 418, 404, 420, 421, 422, 424, and 437.

In an embodiment, the recombinant AAV genome comprises the nucleotide sequences of SEQ ID NOs: 408, 417, 418, 405, 420, 421, 422, 424, and 437.

In an embodiment, the recombinant AAV genome comprises the nucleotide sequences of SEQ ID NOs: 408, 417, 418, 406, 420, 421, 422, 424, and 437.

In an embodiment, the recombinant AAV genome further comprises the nucleotide sequences of SEQ ID NO: 416, 419, 425, and 427.

In an embodiment, the recombinant AAV genome further comprises the nucleotide sequence of SEQ ID NO: 423.

In an embodiment, the recombinant AAV genome comprises any of the nucleotide sequences of SEQ ID NOs: 428-433.

In an embodiment, the recombinant AAV genome comprises, or consists of, a nucleotide sequence that is the same as, differs by no more than 100, 200, 300, 400, or 500 nucleotides from, or has at least has at least 90%, 92%, 94%, 96%, 98%, or 99% homology with any of the nucleotide sequences shown in FIG. 19A-19G, 20A-20F, 21A-21F, 22A-22F, 23A-23F, or 24A-24F, or any of the nucleotide sequences of SEQ ID NOs: 428-433 or 436-444.

In an embodiment, the recombinant AAV genome comprises, or consists of, a nucleotide sequence that is the same as any of the nucleotide sequences shown in FIGS. 19A-19G, 20A-20F, 21A-21F, 22A-22F, 23A-23F, or 24A-24F, or any of the nucleotide sequences of SEQ ID NOs: 428-433 or 436-444.

In an embodiment, the recombinant AAV genome comprises or consists of one or more (e.g., 2, 3, 4, 5, 6, 7, 8, 9, 10, 11, 12 or all) of the component sequences shown in FIG. 19A-19G, 20A-20F, 21A-21F, 22A-22F, 23A-23F, or 24A-24F, or Tables 20 or 25-27, or any of the nucleotide sequences of SEQ ID NOs: 428-433 or 436-444.

Unless otherwise indicated, when components of a recombinant AAV genome are described herein, the order can be as provided, but other orders are included as well. In other words, in an embodiment, the order is as set out in the text, but in other embodiments, the order can be different.

It is understood that the recombinant AAV genomes disclosed herein can be single stranded or double stranded.

Disclosed herein are also the reverse, complementary form of any of the recombinant AAV genomes disclosed herein, and the double stranded form thereof.

In another aspect, disclosed herein is a nucleic acid molecule (e.g., an expression vector) that comprises a recombinant AAV genome disclosed herein. In an embodiment, the nucleic acid molecule further comprises a nucleotide sequence that encodes an antibiotic resistant gene (e.g., an Amp resistant gene). In an embodiment, the nucleic acid molecule further comprises replication origin sequence (e.g., a ColE1 origin, an M13 origin, or both).

In another aspect, disclosed herein is a recombinant AAV viral particle comprising a recombinant AAV genome disclosed herein.

In an embodiment, the recombinant AAV viral particle has any of the serotype disclosed herein, e.g., in Table 25, or a combination thereof. In another embodiment, the recombinant AAV viral particle has a tissue specificity of retinal pigment epithelium cells, photoreceptors, horizontal cells, bipolar cells, amacrine cells, ganglion cells, or a combination thereof.

In another aspect, disclosed herein is a method of producing a recombinant AAV viral particle disclosed herein comprising providing a recombinant AAV genome disclosed herein and one or more capsid proteins under conditions that allow for assembly of an AAV viral particle.

In another aspect, disclosed herein is a method of altering a cell comprising contacting the cell with a recombinant AAV viral particle disclosed herein.

In another aspect, disclosed herein is a method of treating a subject having or likely to develop LCA10 comprising contacting the subject (or a cell from the subject) with a recombinant viral particle disclosed herein.

In another aspect, disclosed herein is a recombinant AAV viral particle comprising a recombinant AAV genome disclosed herein for use in treating LCA10 in a subject.

In another aspect, disclosed herein is use of a recombinant AAV viral particle comprising a recombinant AAV genome disclosed herein in the manufacture of a medicament for treating LCA10 in a subject.

The gRNA molecules and methods, as disclosed herein, can be used in combination with a governing gRNA molecule, comprising a targeting domain which is complementary to a target domain on a nucleic acid that encodes a component of the CRISPR/Cas system introduced into a cell or subject. In an embodiment, the governing gRNA molecule targets a nucleic acid that encodes a Cas9 molecule or a nucleic acid that encodes a target gene gRNA molecule. In an embodiment, the governing gRNA comprises a targeting domain that is complementary to a target domain in a sequence that encodes a Cas9 component, e.g., a Cas9 molecule or target gene gRNA molecule. In an embodiment, the target domain is designed with, or has, minimal homology to other nucleic acid sequences in the cell, e.g., to minimize off-target cleavage. For example, the targeting domain on the governing gRNA can be selected to reduce or minimize off-target effects. In an embodiment, a target domain for a governing gRNA can be disposed in the control or coding region of a Cas9 molecule or disposed between a control region and a transcribed region. In an embodiment, a target domain for a governing gRNA can be disposed in the control or coding region of a target gene gRNA molecule or disposed between a control region and a transcribed region for a target gene gRNA. While not wishing to be bound by theory, in an embodiment, it is believed that altering, e.g., inactivating, a nucleic acid that encodes a Cas9 molecule or a nucleic acid that encodes a target gene gRNA molecule can be effected by cleavage of the targeted nucleic acid sequence or by binding of a Cas9 molecule/governing gRNA molecule complex to the targeted nucleic acid sequence.

The compositions, reaction mixtures and kits, as disclosed herein, can also include a governing gRNA molecule, e.g., a governing gRNA molecule disclosed herein.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In addition, the materials, methods, and examples are illustrative only and not intended to be limiting.

Headings, including numeric and alphabetical headings and subheadings, are for organization and presentation and are not intended to be limiting.

Other features and advantages of the invention will be apparent from the detailed description, drawings, and from the claims.

BRIEF DESCRIPTION OF THE DRAWINGS

FIGS. 1A-1G are representations of several exemplary gRNAs.

FIG. 1A depicts a modular gRNA molecule derived in part (or modeled on a sequence in part) from *Streptococcus pyogenes* (*S. pyogenes*) as a duplexed structure (SEQ ID NOs: 42 and 43, respectively, in order of appearance);

FIG. 1B depicts a unimolecular (or chimeric) gRNA molecule derived in part from *S. pyogenes* as a duplexed structure (SEQ ID NO: 44);

FIG. 1C depicts a unimolecular gRNA molecule derived in part from *S. pyogenes* as a duplexed structure (SEQ ID NO: 45);

FIG. 1D depicts a unimolecular gRNA molecule derived in part from *S. pyogenes* as a duplexed structure (SEQ ID NO: 46);

FIG. 1E depicts a unimolecular gRNA molecule derived in part from *S. pyogenes* as a duplexed structure (SEQ ID NO: 47);

FIG. 1F depicts a modular gRNA molecule derived in part from *Streptococcus thermophilus* (*S. thermophilus*) as a duplexed structure (SEQ ID NOs: 48 and 49, respectively, in order of appearance);

FIG. 1G depicts an alignment of modular gRNA molecules of *S. pyogenes* (SEQ ID NOs: 42 and 52) and *S. thermophilus* (SEQ ID NOs: 48 and 49).

FIGS. 2A-2G depict an alignment of Cas9 sequences from Chylinski 2013. The N-terminal RuvC-like domain is boxed and indicated with a "Y". The other two RuvC-like domains are boxed and indicated with a "B". The HNH-like domain is boxed and indicated by a "G". Sm: *S. mutans* (SEQ ID NO: 1); Sp: *S. pyogenes* (SEQ ID NO: 2); St: *S. thermophilus* (SEQ ID NO: 3); Li: *L. innocua* (SEQ ID NO: 4). Motif: this is a motif based on the four sequences: residues conserved in all four sequences are indicated by single letter amino acid abbreviation; "*" indicates any amino acid found in the corresponding position of any of the four sequences; and "-" indicates any amino acid, e.g., any of the 20 naturally occurring amino acids.

FIGS. 3A-3B show an alignment of the N-terminal RuvC-like domain from the Cas9 molecules disclosed in Chylinski 2013 (SEQ ID NOs: 54, 56, and 58-103, respectively, in order of appearance). The last line of FIG. 3B identifies 4 highly conserved residues.

FIGS. 4A-4B show an alignment of the N-terminal RuvC-like domain from the Cas9 molecules disclosed in Chylinski 2013 with sequence outliers removed. The last line of FIG. 4B identifies 3 highly conserved residues.

FIGS. 5A-5C show an alignment of the HNH-like domain from the Cas9 molecules disclosed in Chylinski 2013 (SEQ ID NOs: 178-252, respectively, in order of appearance). The last line of FIG. 5C identifies conserved residues.

FIGS. 6A-6B show an alignment of the HNH-like domain from the Cas9 molecules disclosed in Chylinski 2013 with sequence outliers removed. The last line of FIG. 6B identifies 3 highly conserved residues.

FIGS. 7A-7B depict an alignment of Cas9 sequences from S. pyogenes and Neisseria meningitidis (N. meningitidis). The N-terminal RuvC-like domain is boxed and indicated with a "Y". The other two RuvC-like domains are boxed and indicated with a "B". The HNH-like domain is boxed and indicated with a "G". Sp: S. pyogenes; Nm: N. meningitidis. Motif: this is a motif based on the two sequences: residues conserved in both sequences are indicated by a single amino acid designation; "*" indicates any amino acid found in the corresponding position of any of the two sequences; "-" indicates any amino acid, e.g., any of the 20 naturally occurring amino acids, and "-" indicates any amino acid, e.g., any of the 20 naturally occurring amino acids, or absent.

FIG. 8 shows a nucleic acid sequence encoding Cas9 of N. meningitidis (SEQ ID NO: 303). Sequence indicated by an "R" is an SV40 NLS; sequence indicated as "G" is an HA tag; and sequence indicated by an "O" is a synthetic NLS sequence; the remaining (unmarked) sequence is the open reading frame (ORF).

FIG. 9A shows the organization of the Cas9 domains, including amino acid positions, in reference to the two lobes of Cas9 (recognition (REC) and nuclease (NUC) lobes). FIG. 9B shows the percent homology of each domain across 83 Cas9 orthologs.)

FIG. 11A shows gene editing (% indels) as assessed by sequencing for S. pyogenes and S. aureus gRNAs when co-expressed with Cas9 in patient-derived IVS26 primary fibroblasts. FIG. 11B shows gene editing (% indels) as assessed by sequencing for S. aureus gRNAs when co-expressed with Cas9 in HEK293 cells.

FIG. 18A (SEQ ID NO: 45) shows an exemplary structure of a unimolecular gRNA molecule derived in part from S. pyogenes as a duplexed structure. FIG. 18B (SEQ ID NO: 2779) shows an exemplary structure of a unimolecular gRNA molecule derived in part from S. aureus as a duplexed structure.

Figure 19A:
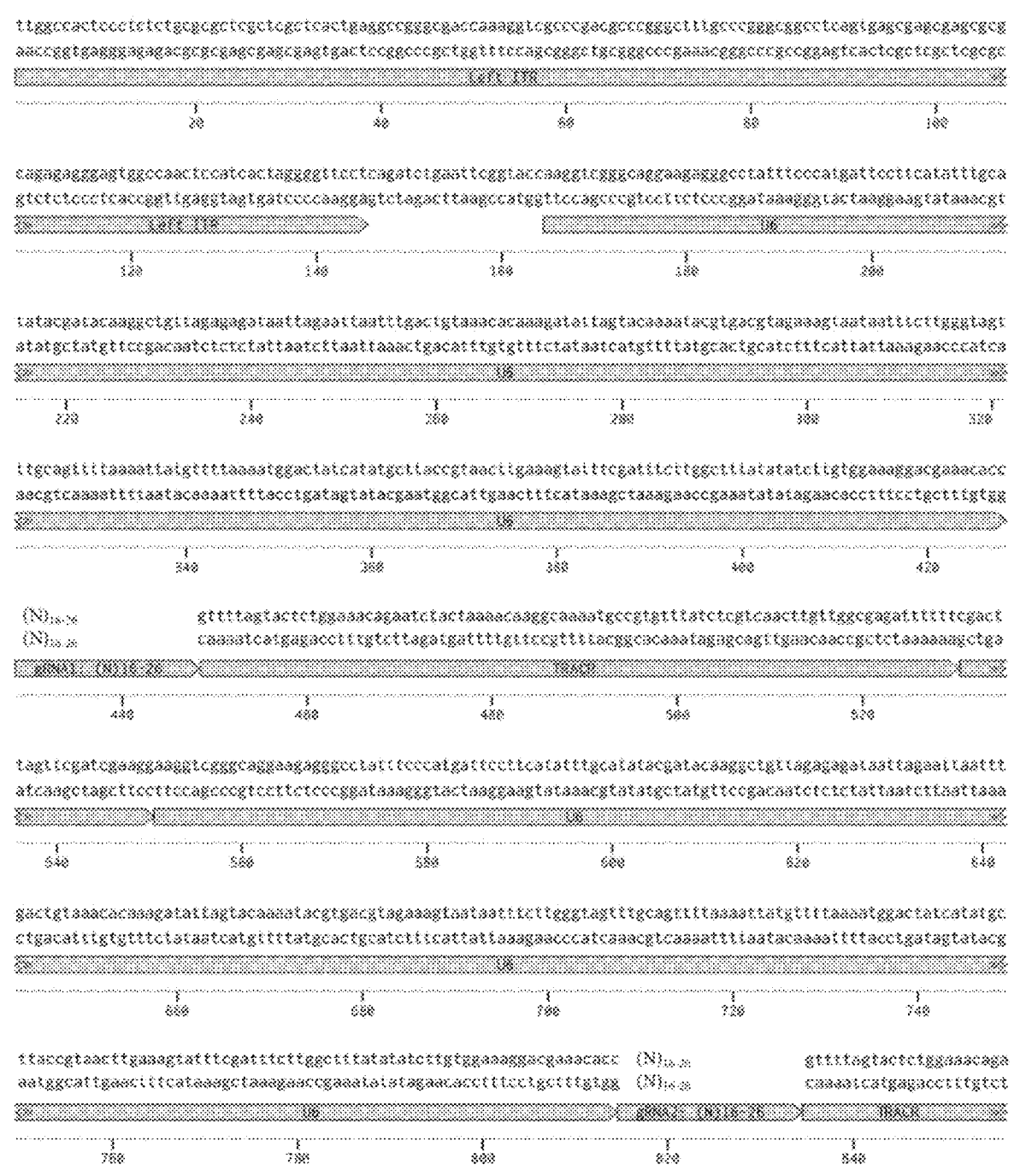
Figure 19B:
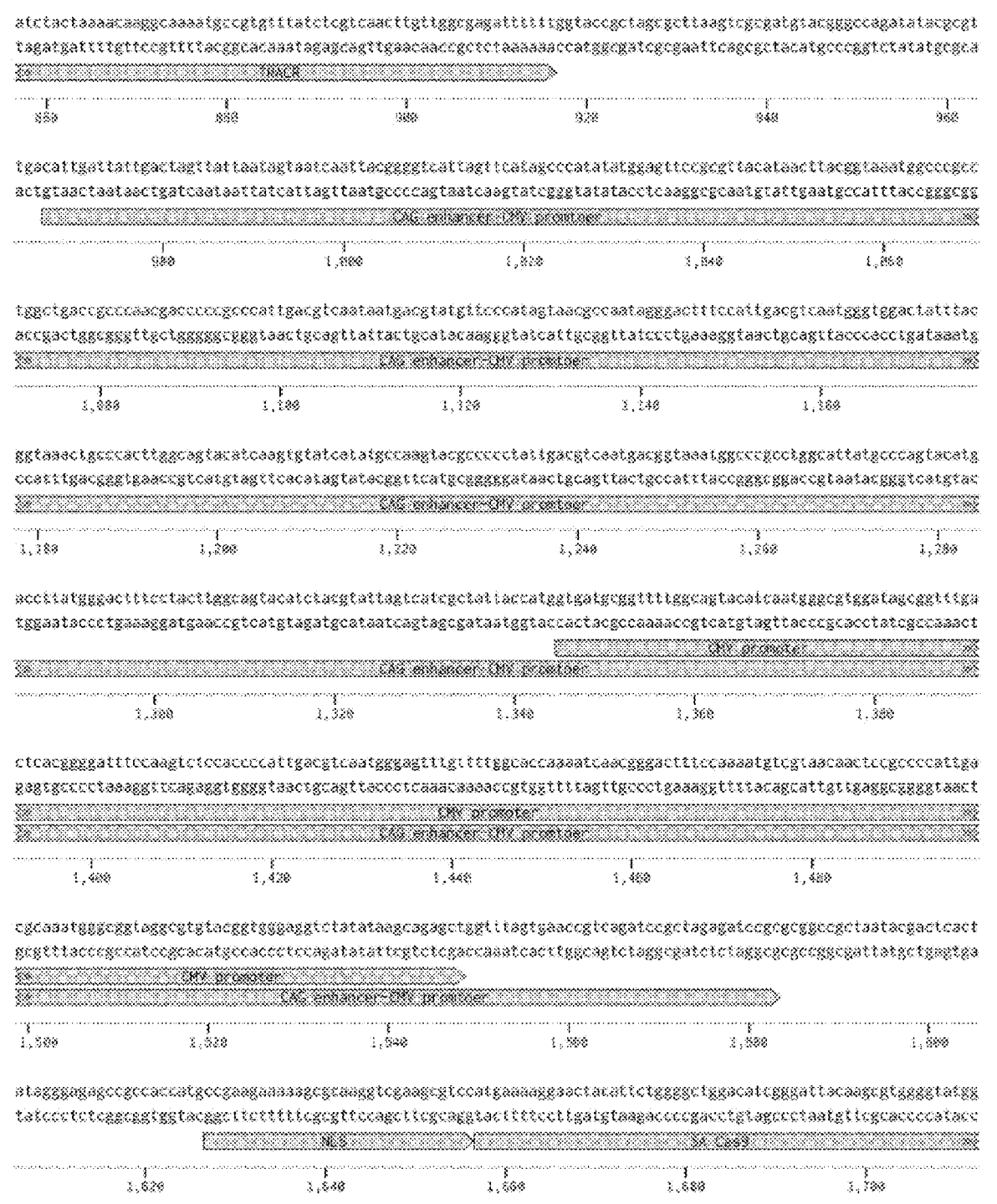
Figure 19C:
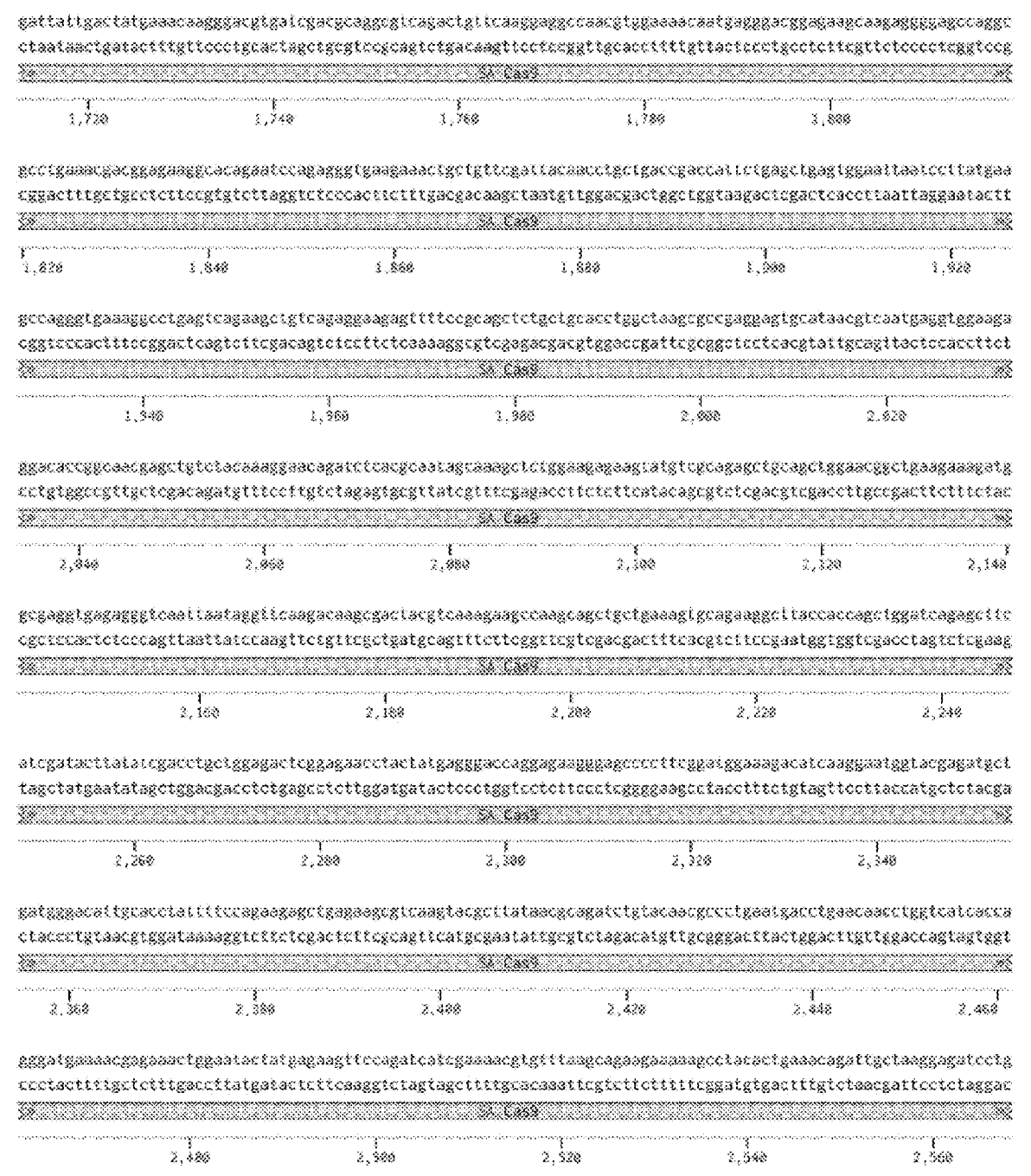
Figure 19D:
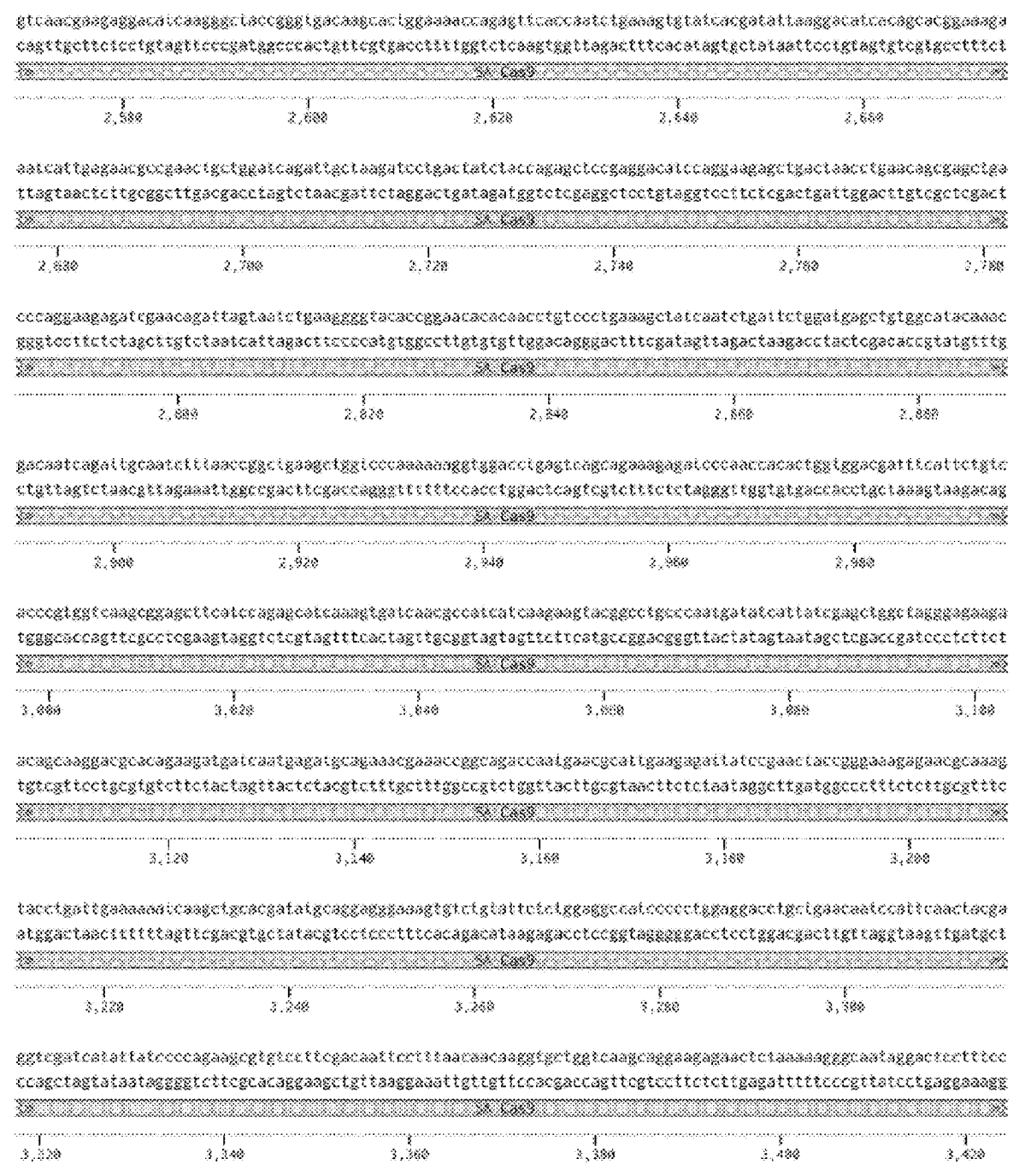
Figure 19E:
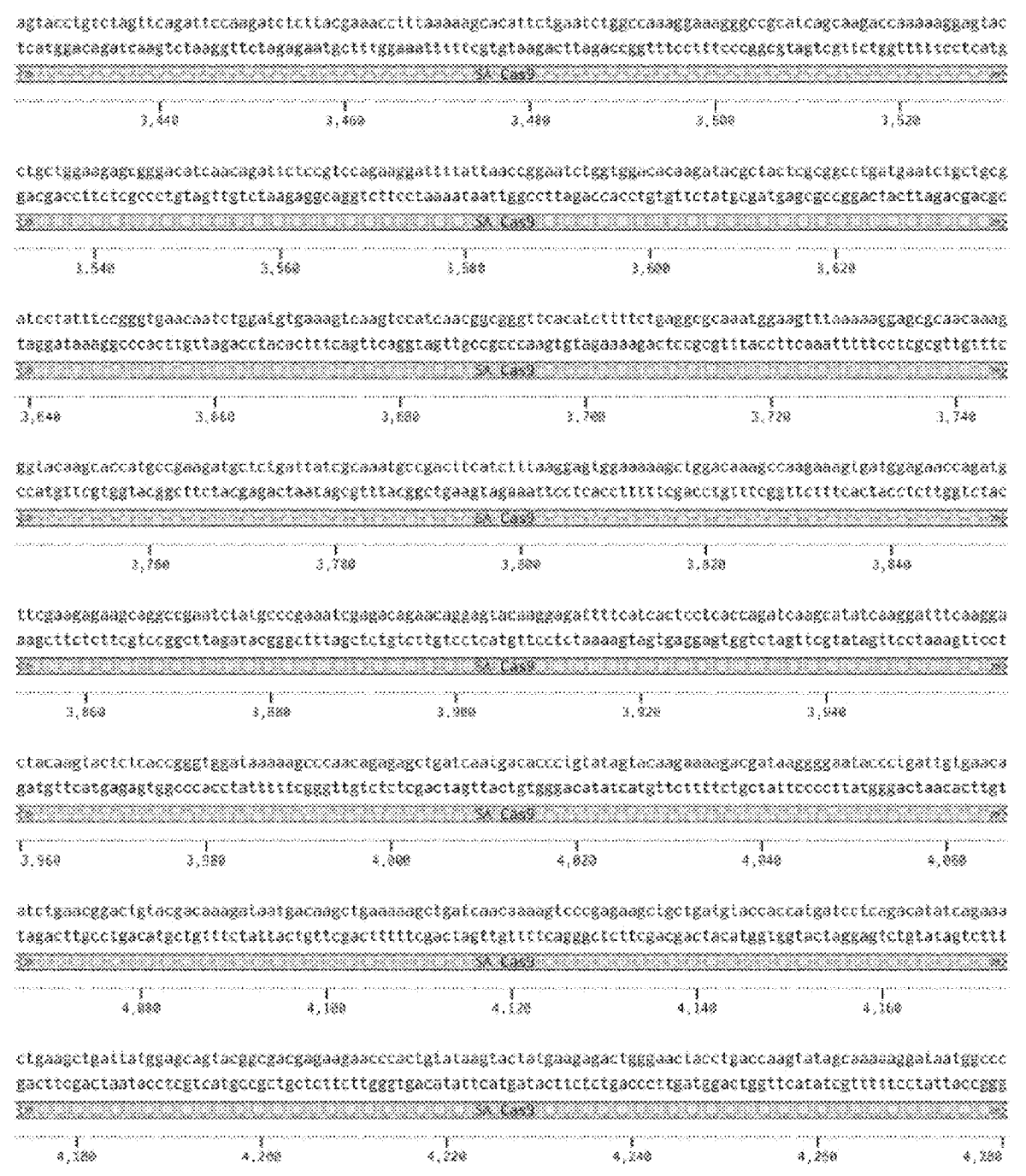
Figure 19F:
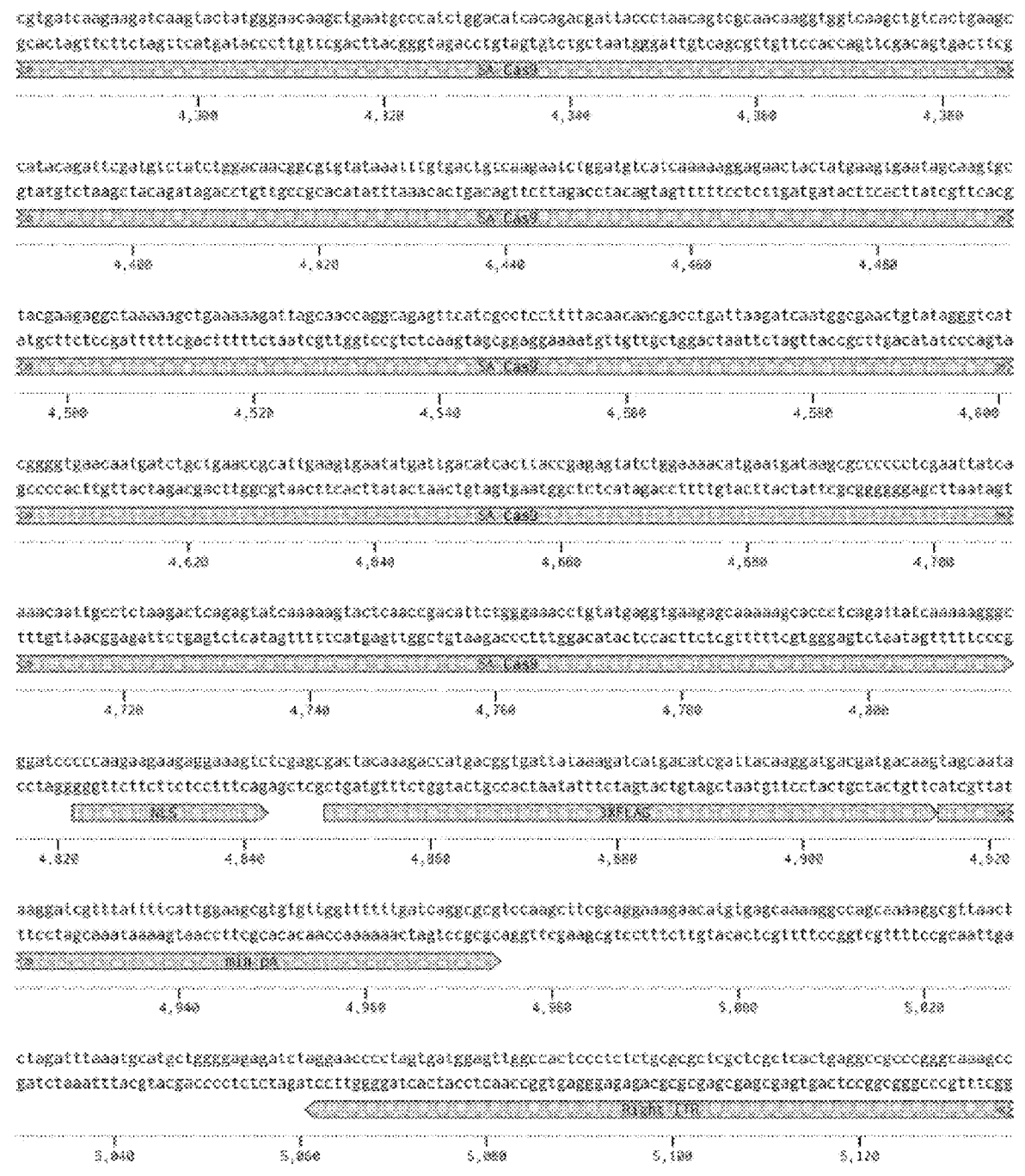

FIGS. 19A-19G depicts the nucleotide sequence of an exemplary recombinant AAV genome containing a CMV promoter. Various components of the recombinant AAV genome are also indicated. N=A, T, G or C. The number of N residues can vary, e.g., from 16 to 26 nucleotides. Upper stand: 5'→6' (SEQ ID NO: 428); lower stand: 3'→5' SEQ ID NO: 445).

Figure 20A:
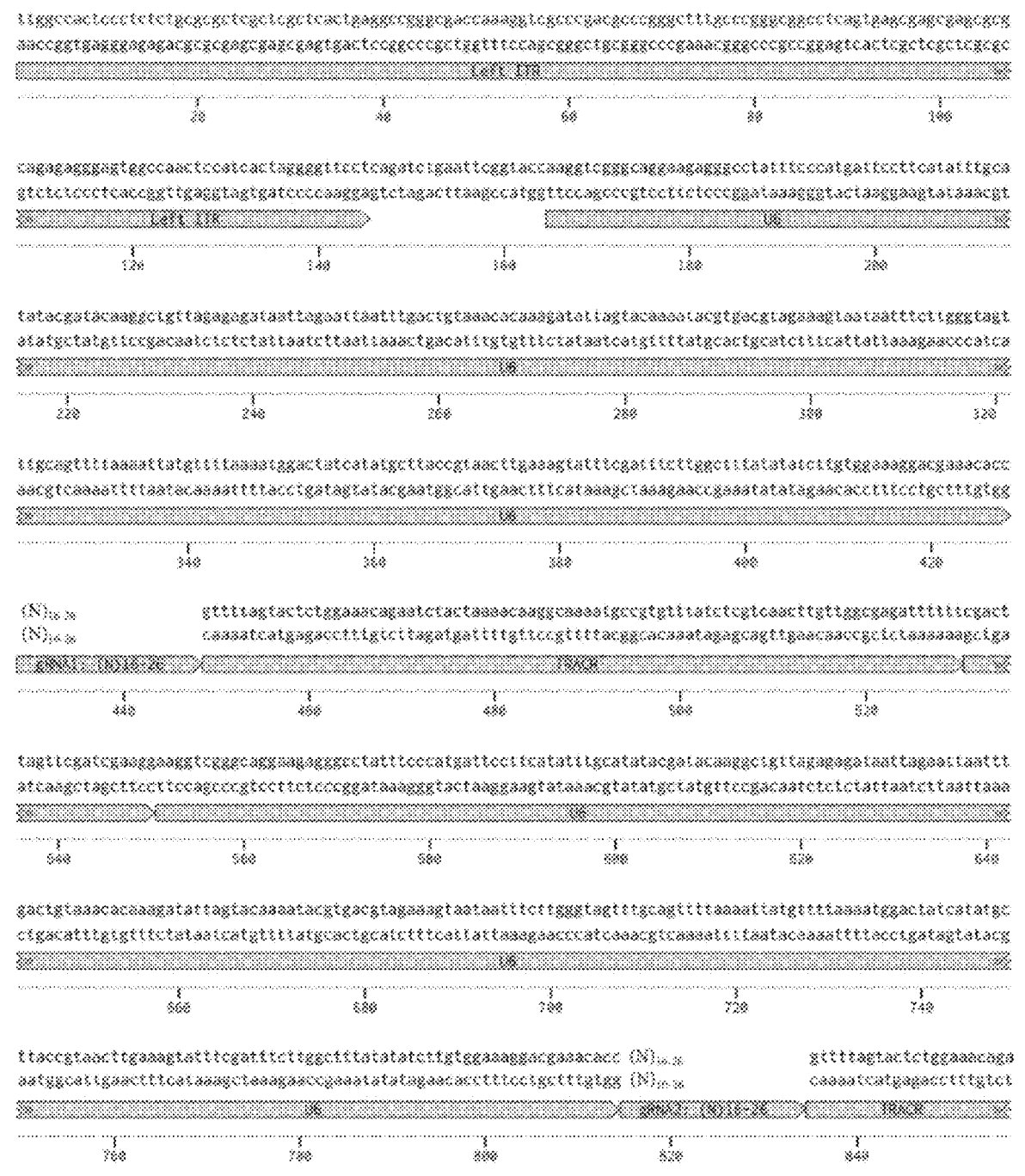
Figure 20B:
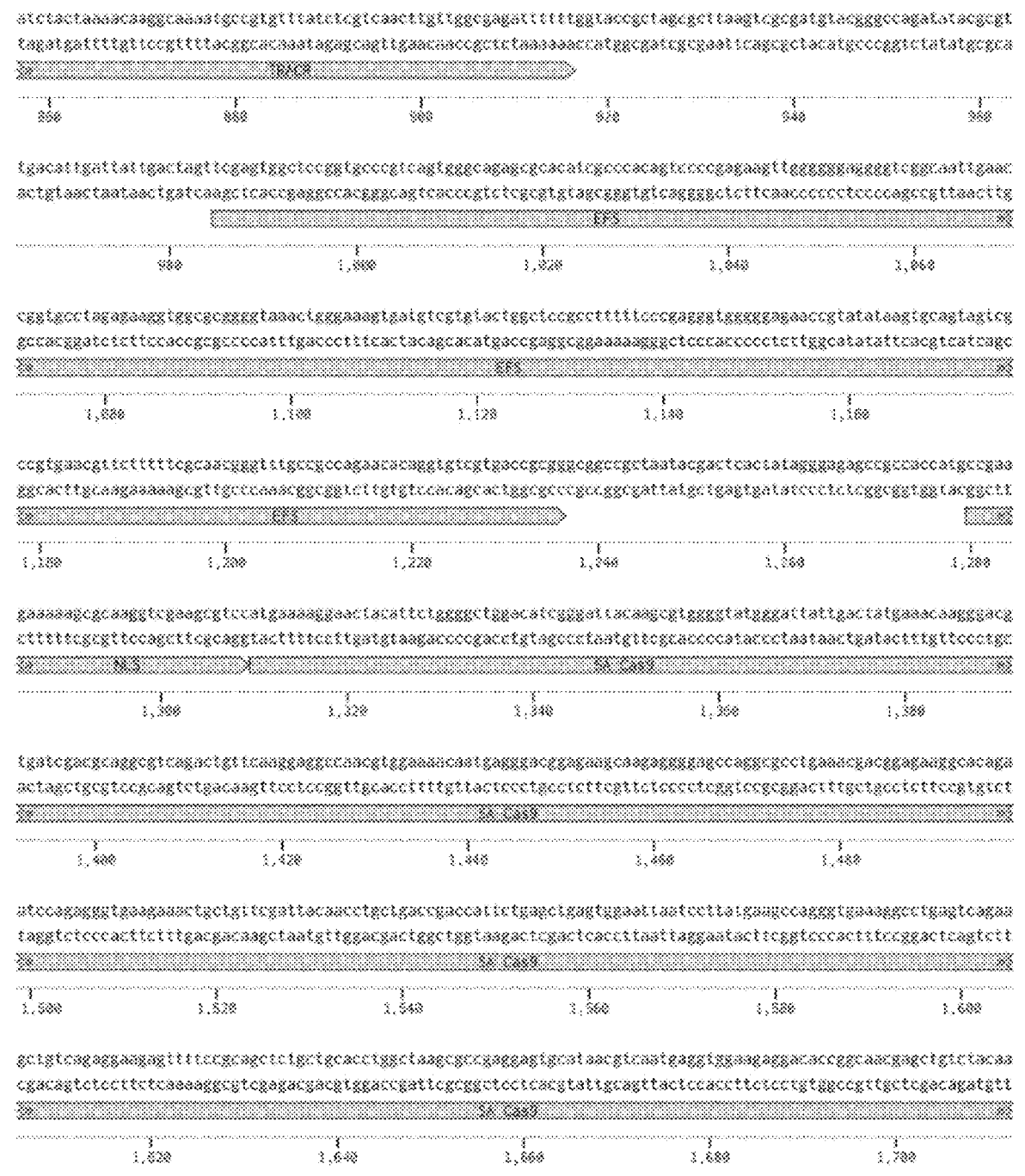
Figure 20C:
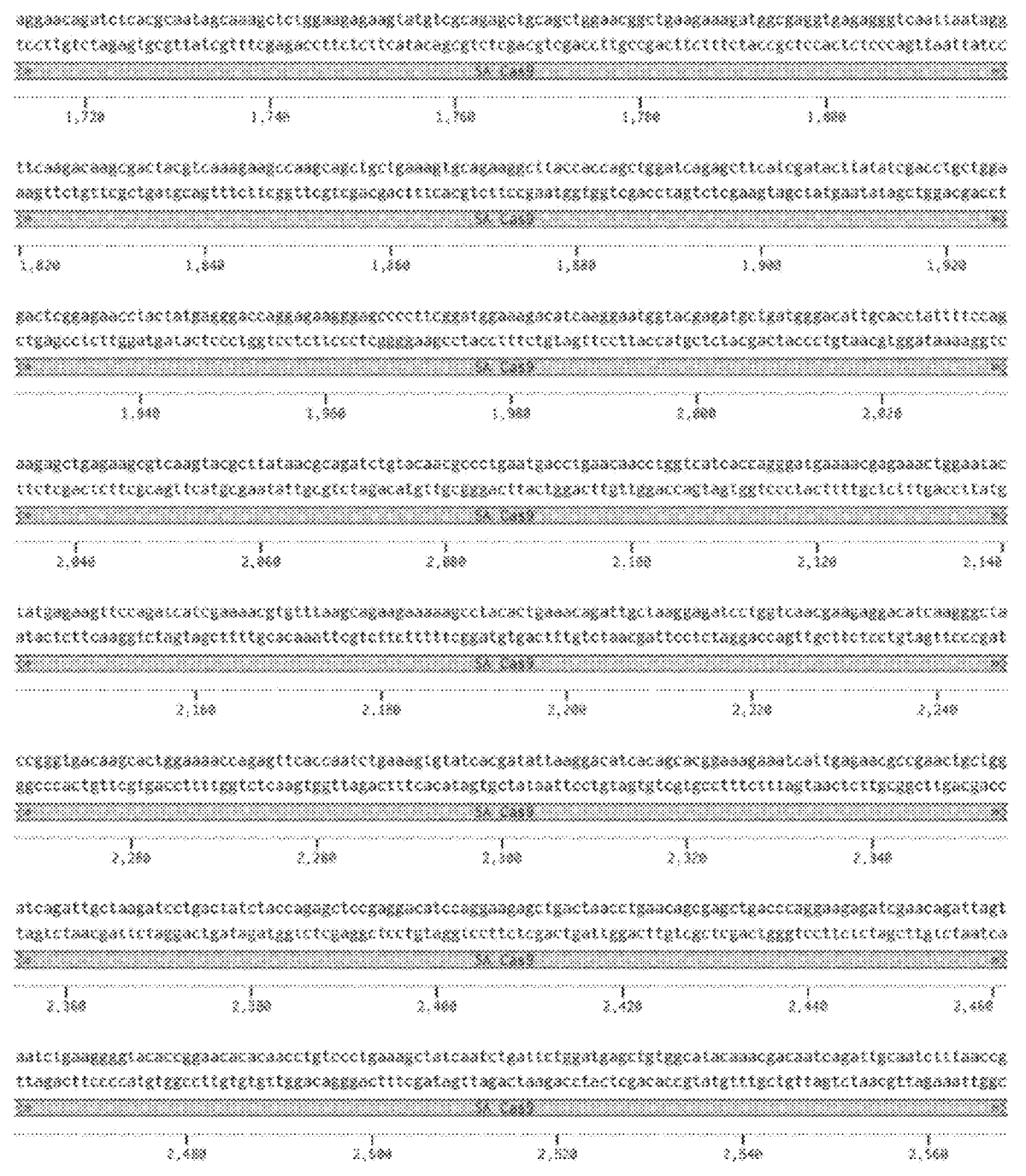
Figure 20D:
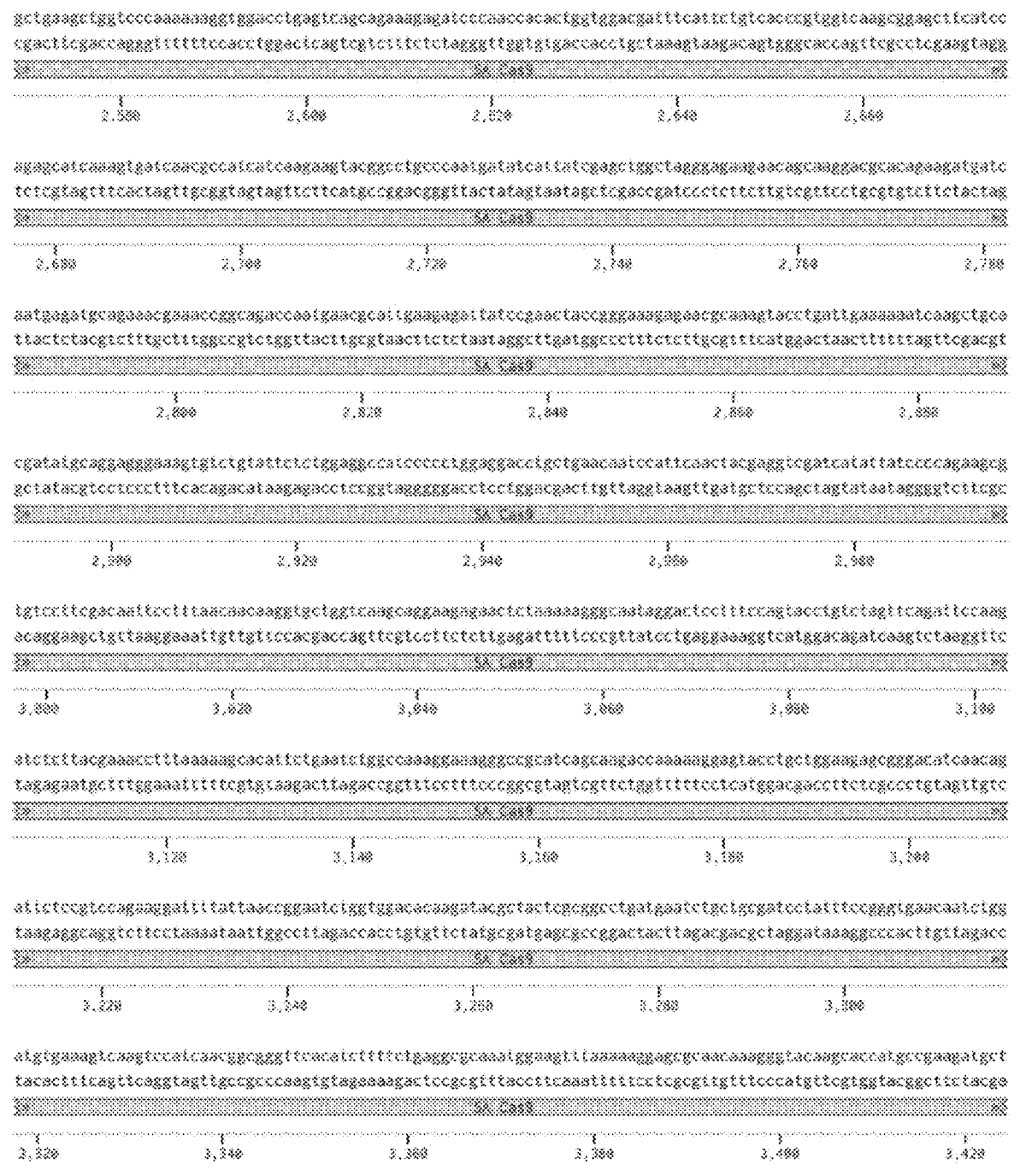
Figure 20E:
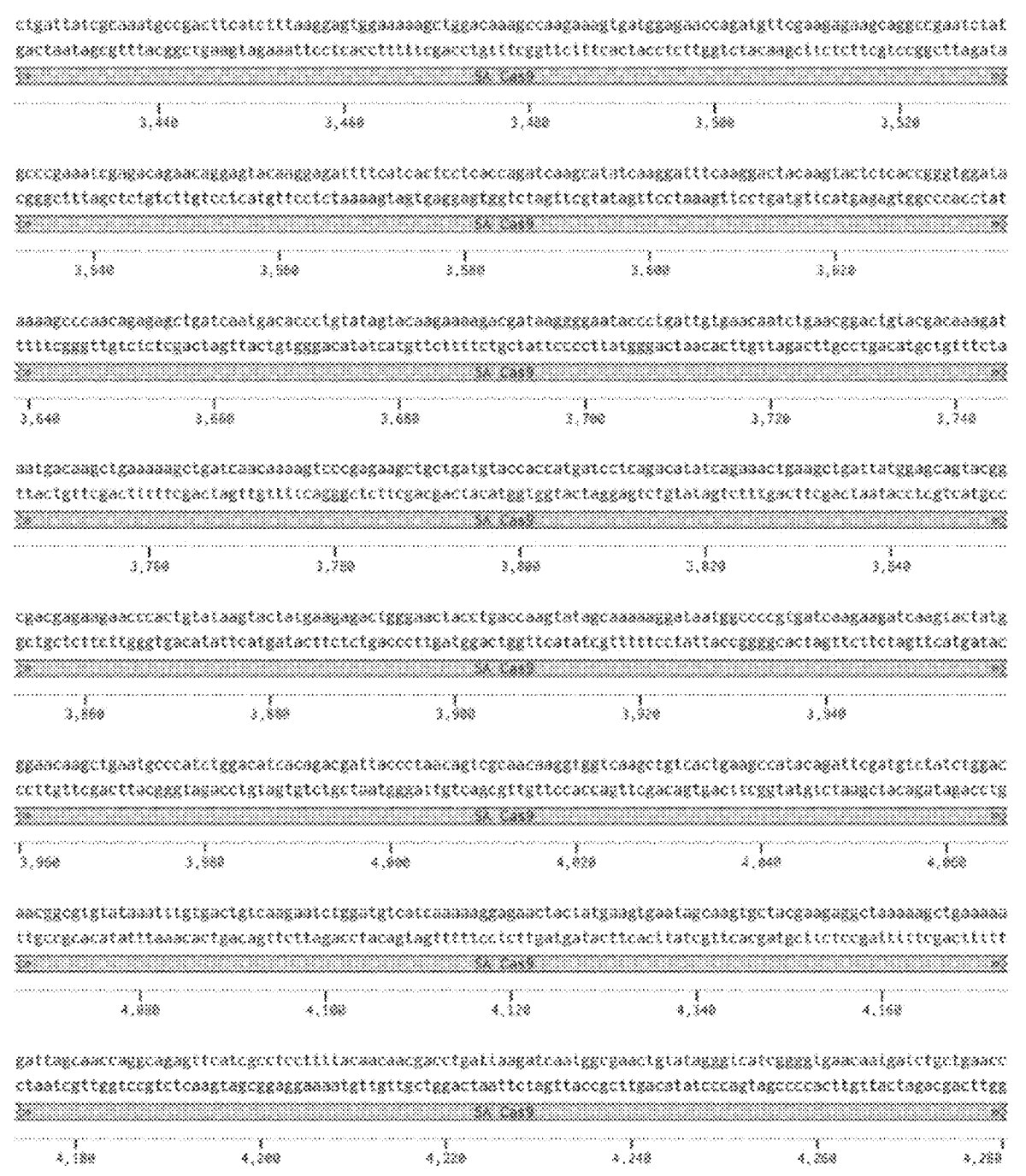
Figure 20F:
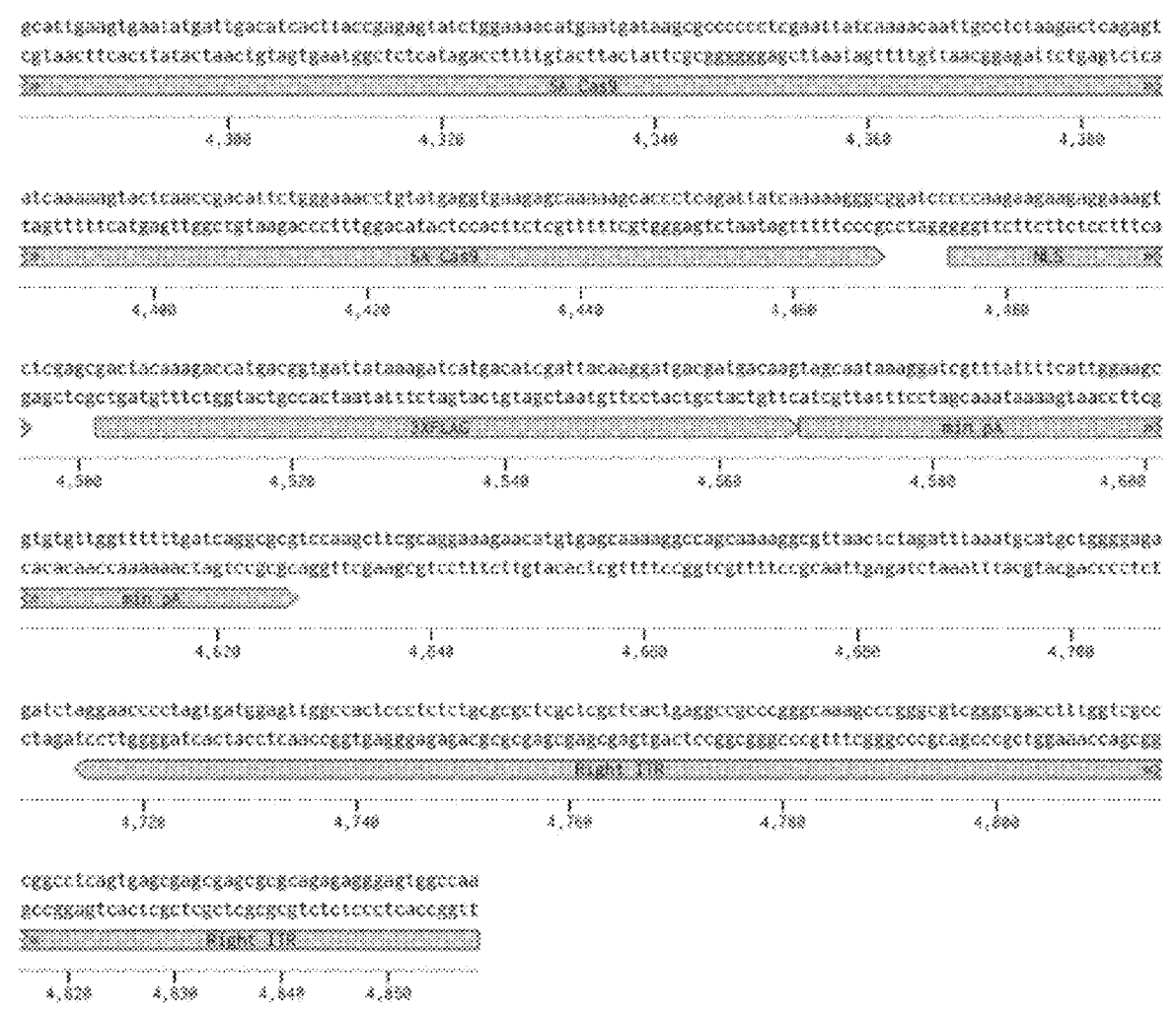

FIGS. 20A-20F depicts the nucleotide sequence of an exemplary recombinant AAV genome containing an EFS promoter. Various components of the recombinant AAV genome are also indicated. N=A, T, G or C. The number of N residues can vary, e.g., from 16 to 26 nucleotides. Upper stand: 5'→6' (SEQ ID NO: 429); lower stand: 3'→45' (SEQ ID NO: 446).

Figure 21A:
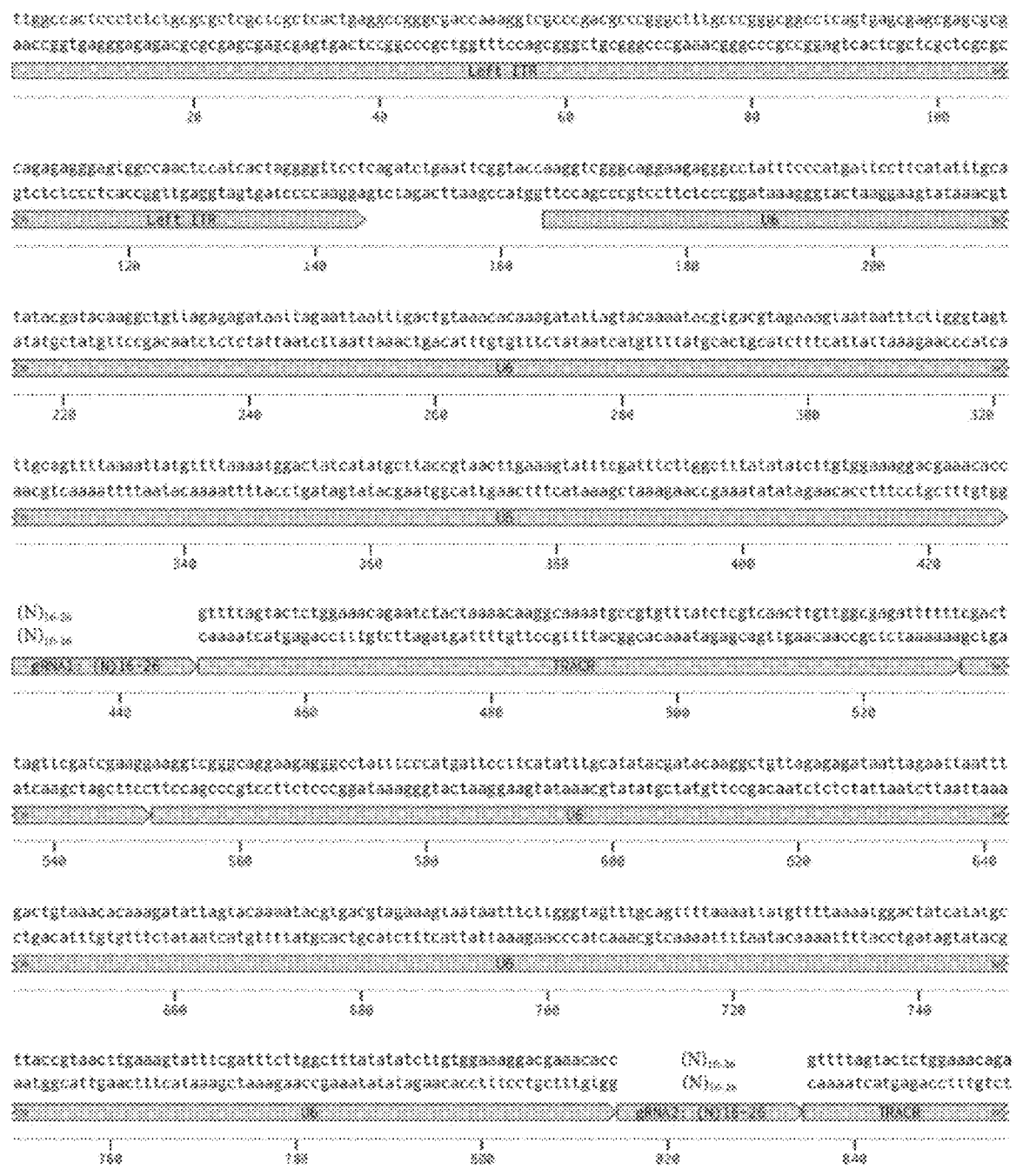
Figure 21B:
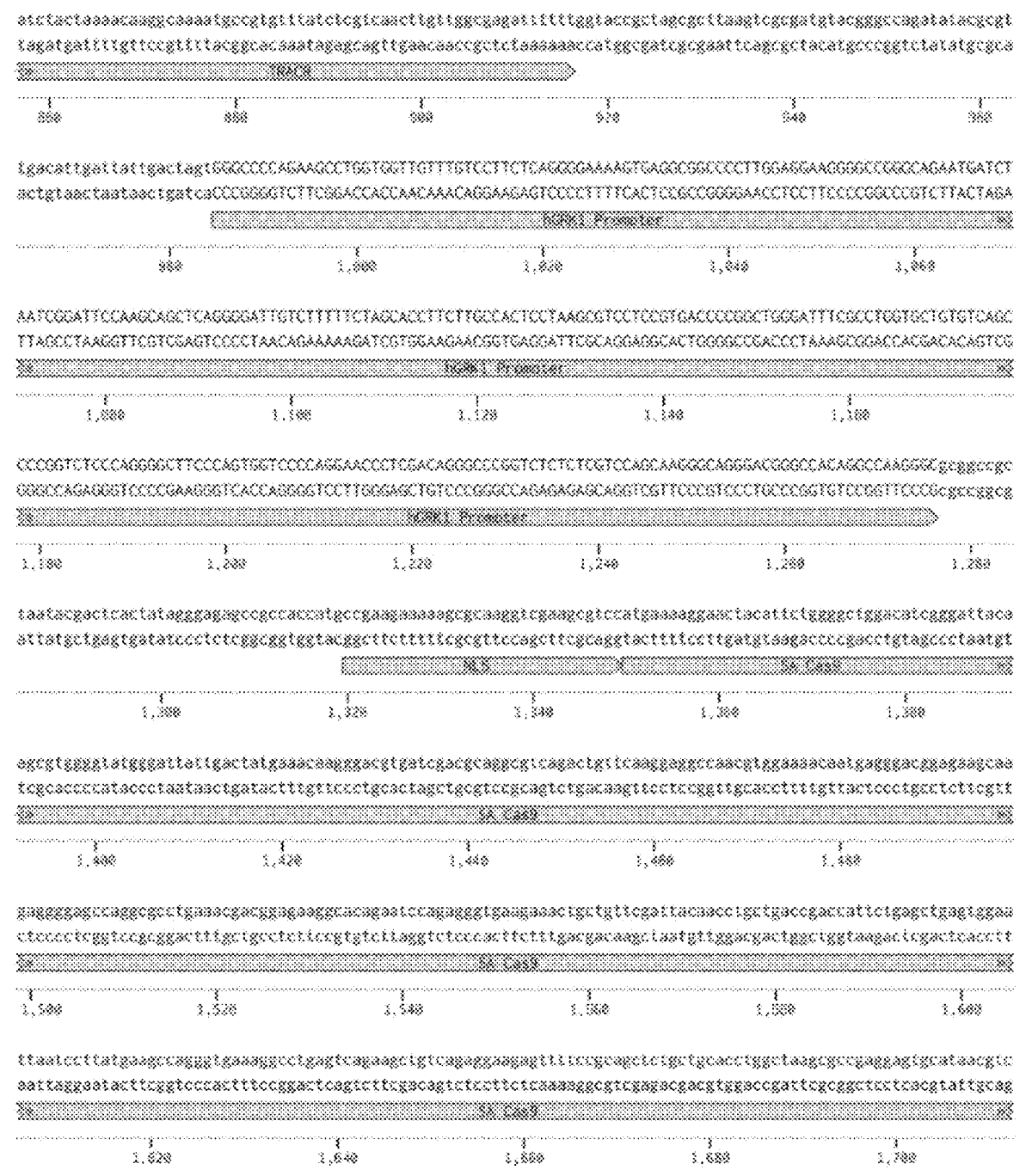
Figure 21C:
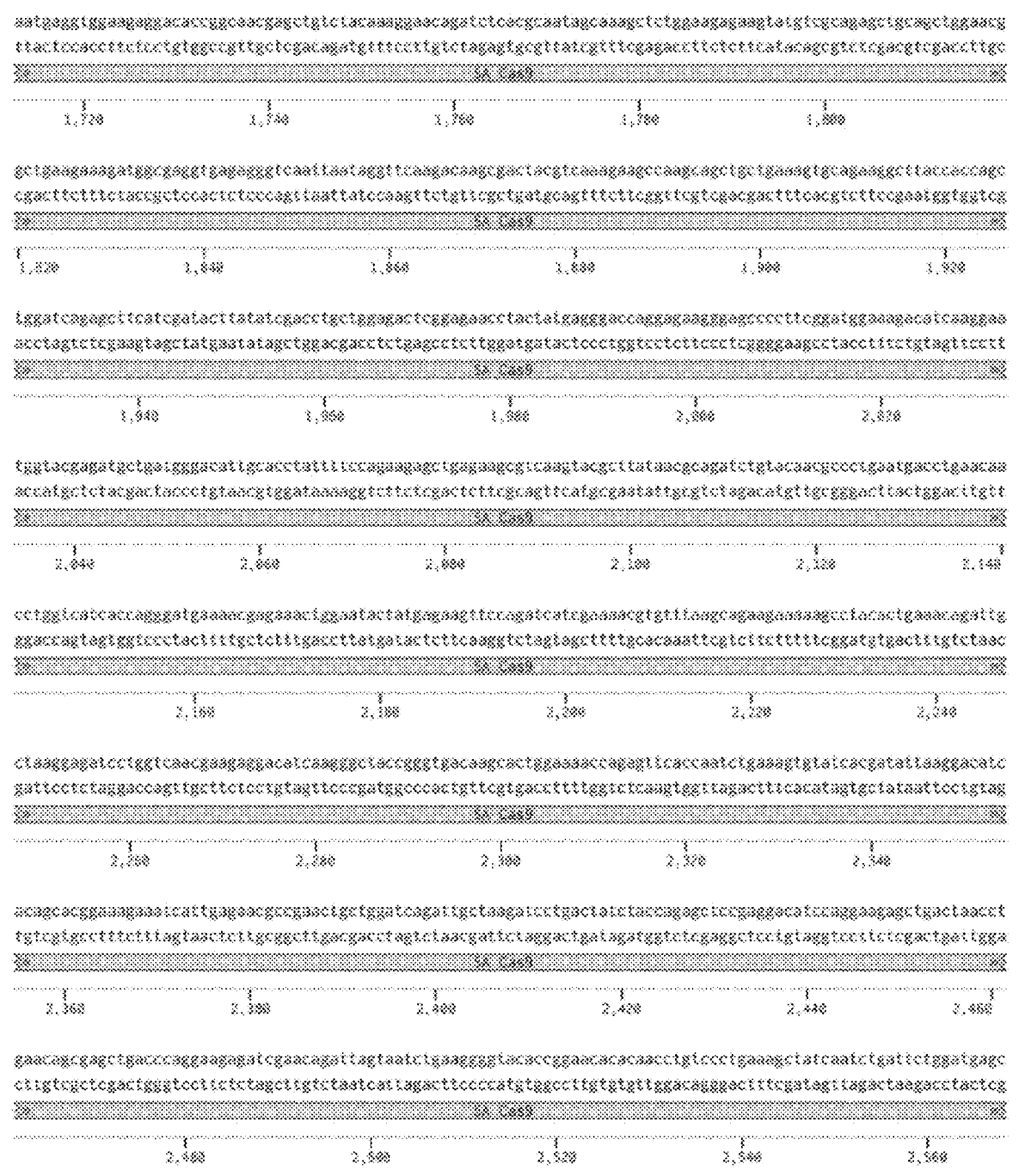
Figure 21D:
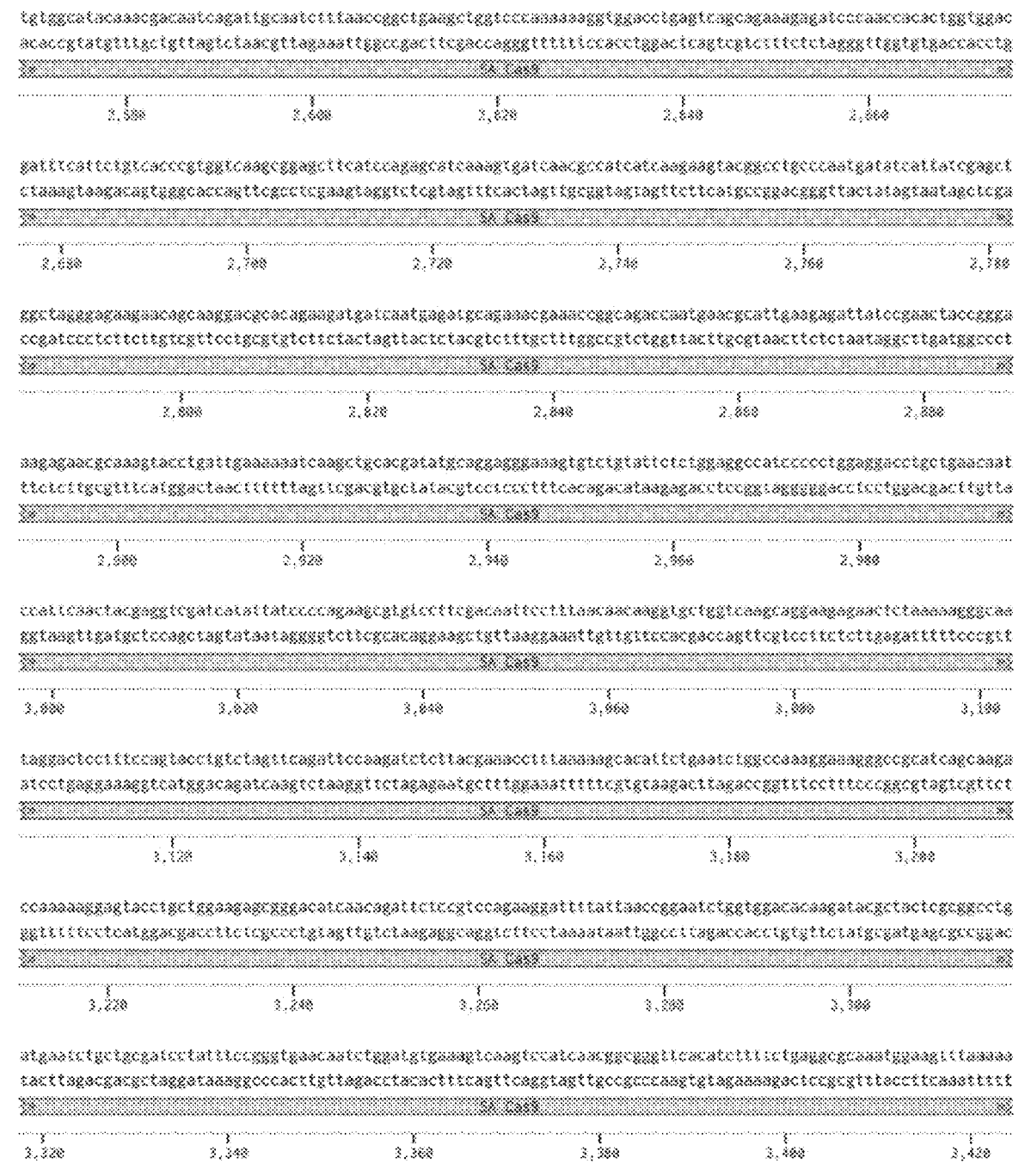
Figure 21E:
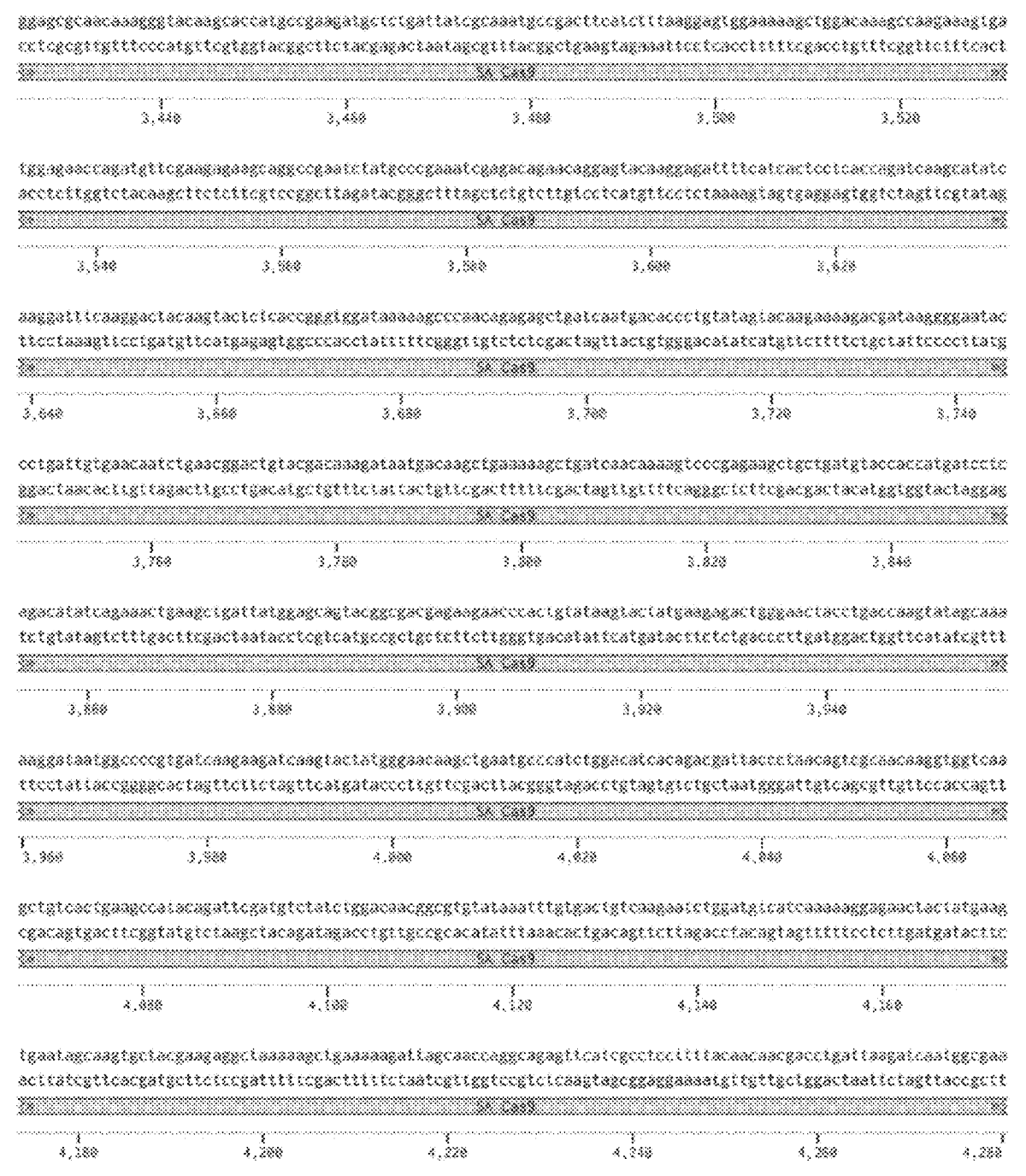
Figure 21F:
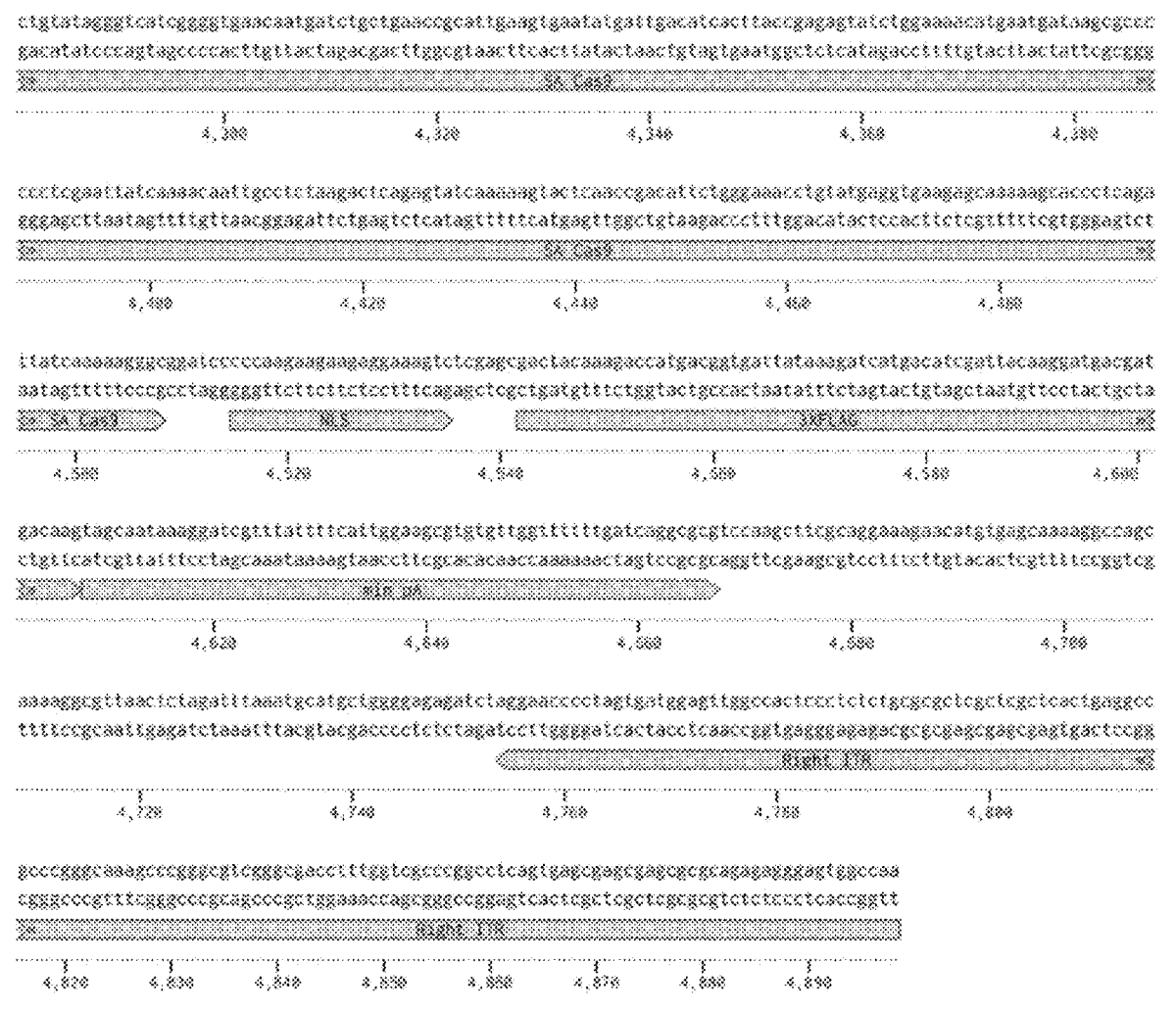

FIGS. 21A-21F depicts the nucleotide sequence of an exemplary recombinant AAV genome containing a CRK1 promoter. Various components of the recombinant AAV genome are also indicated. N=A, T, G or C. The number of N residues can vary, e.g., from 16 to 26 nucleotides. Upper stand: (SEQ ID NO: 430); lower stand: 3'→5' (SEQ ID NO: 447).

Figure 22A:
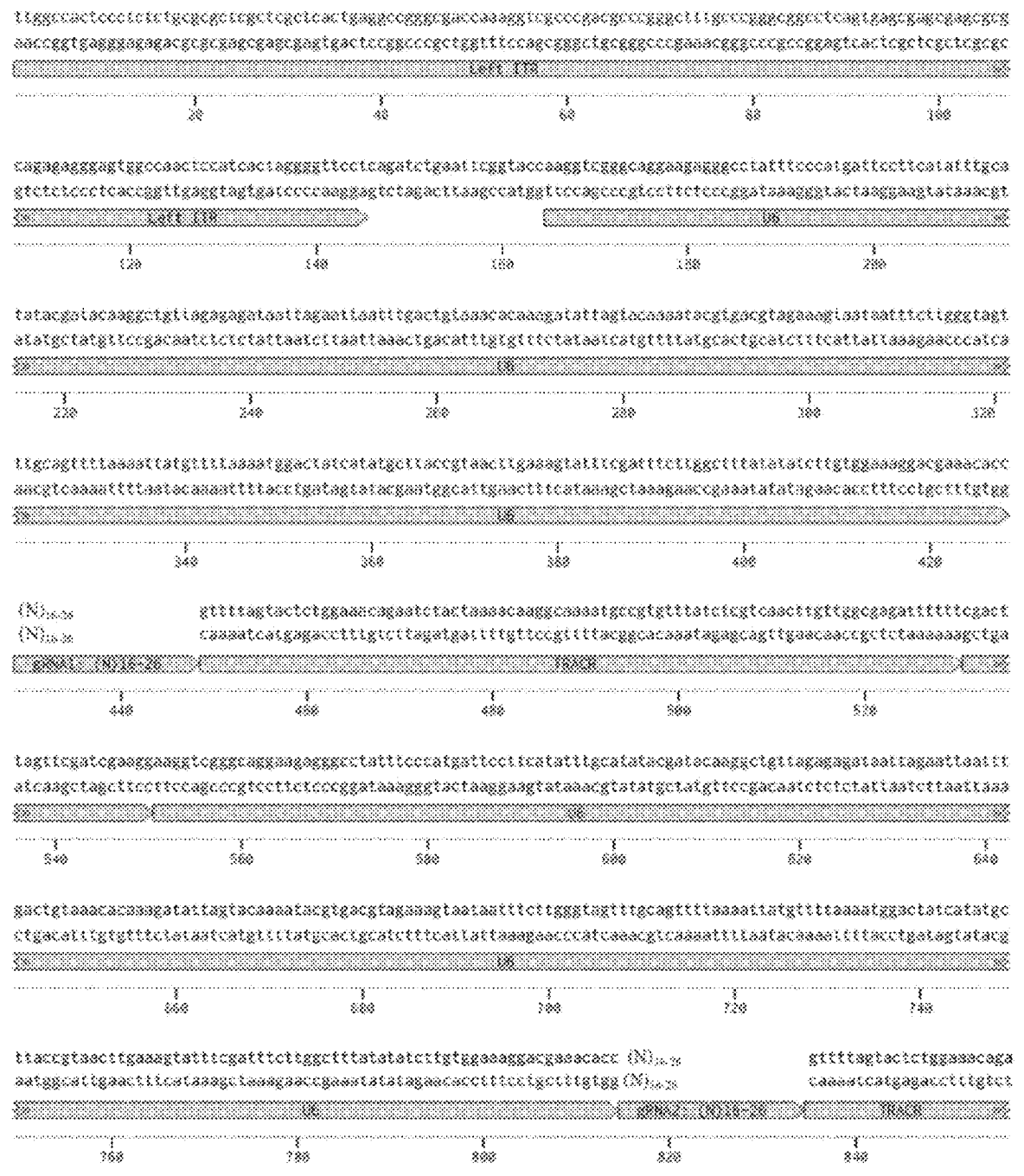
Figure 22B:
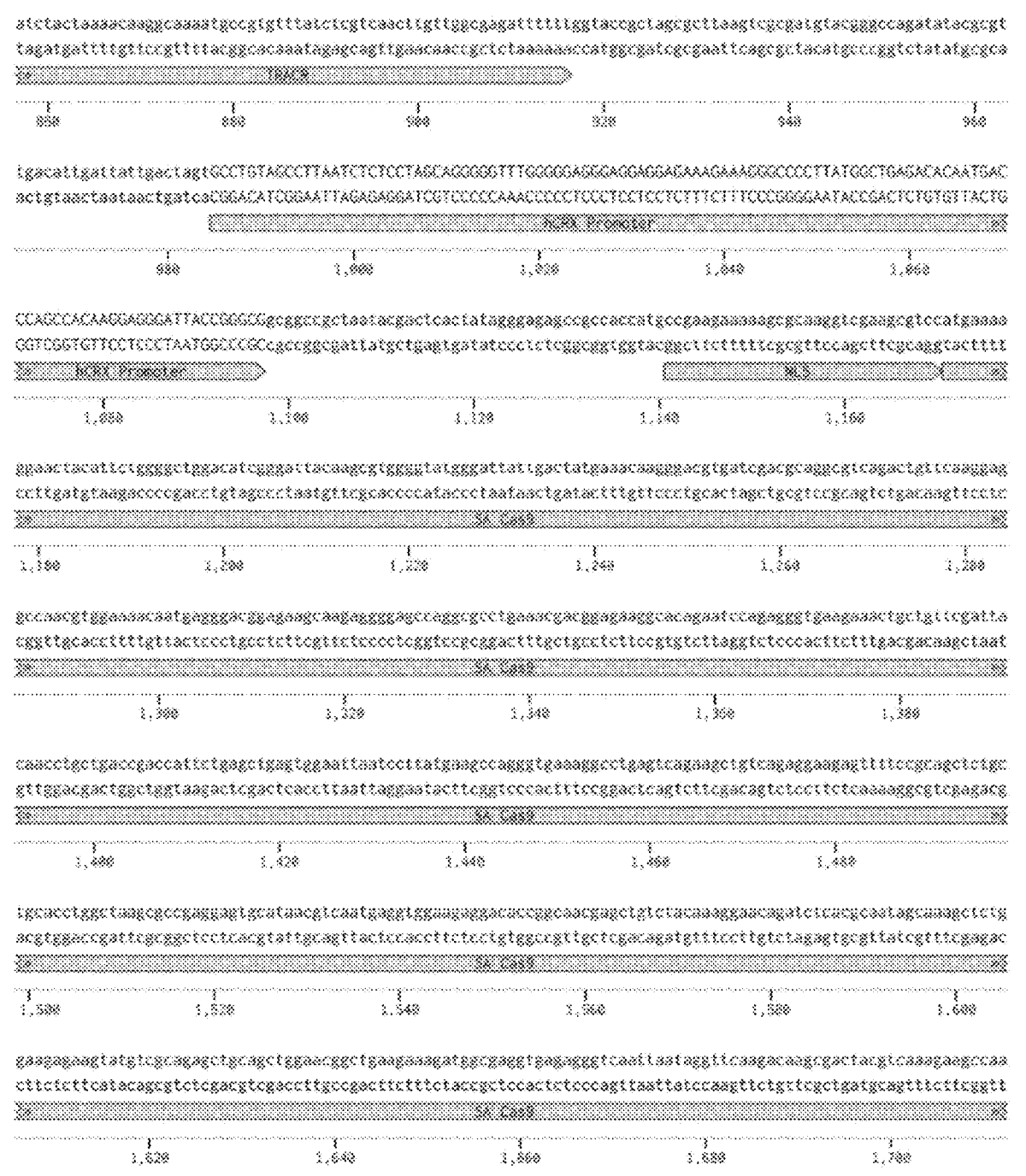
Figure 22C:
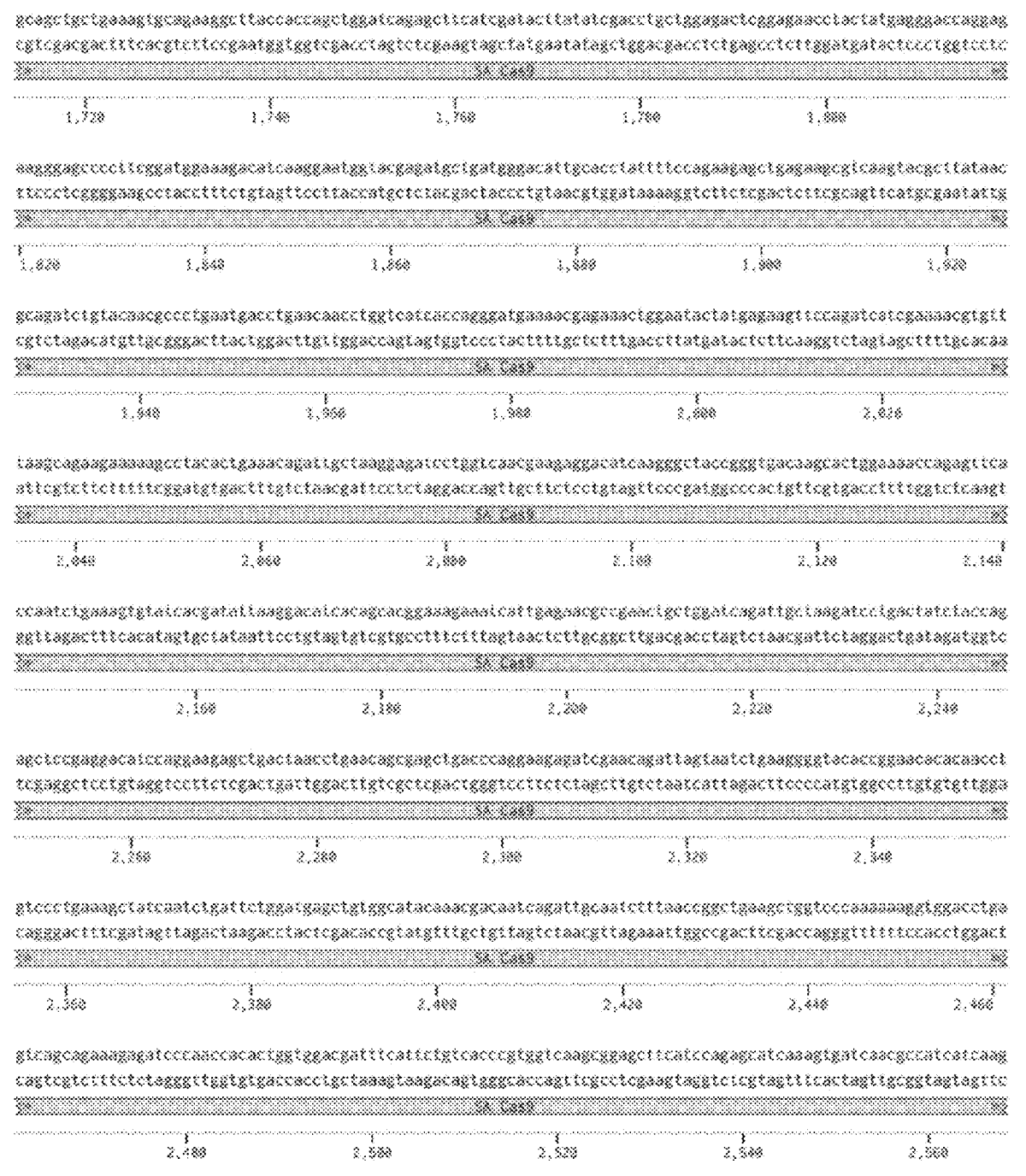
Figure 22D:
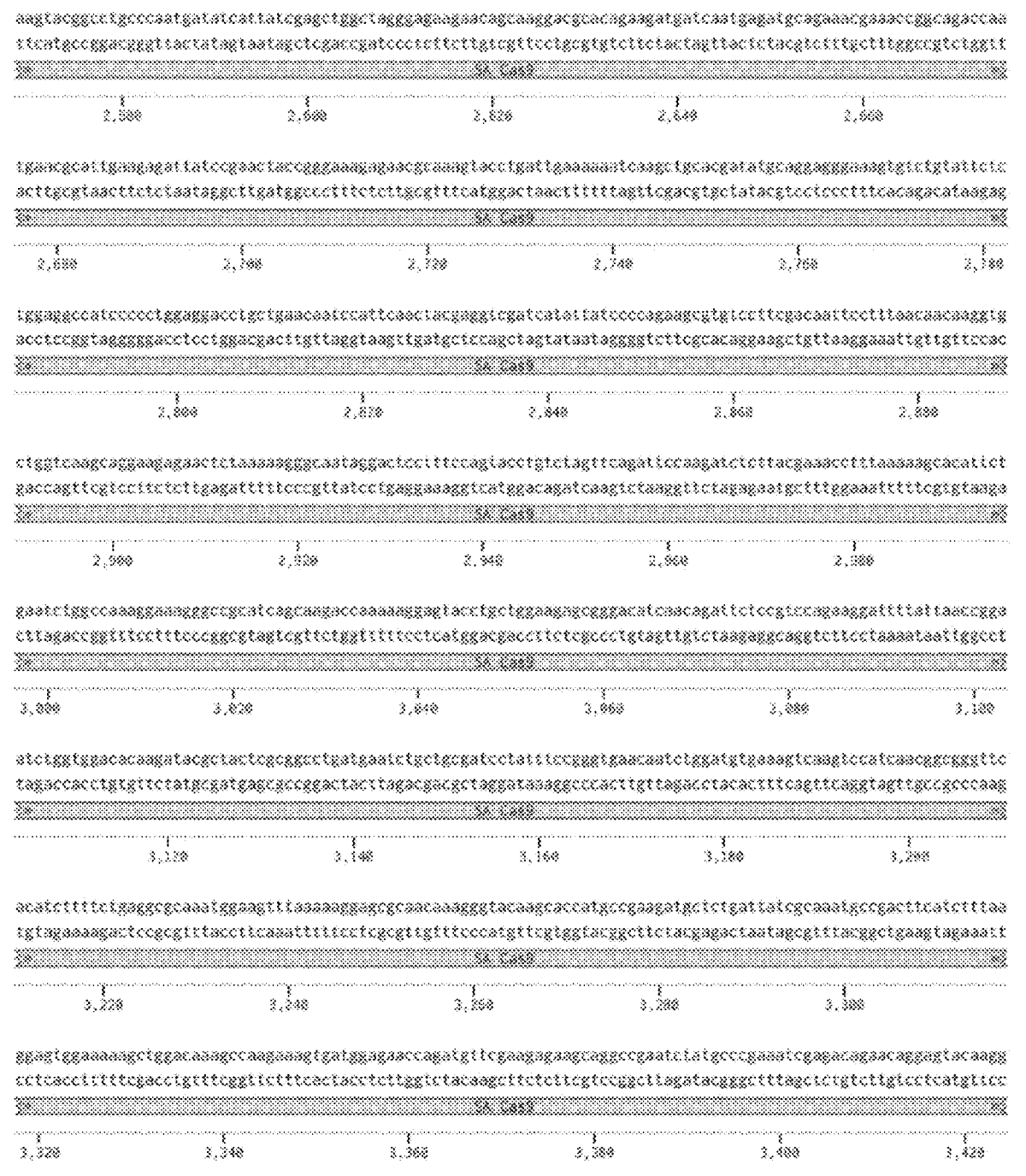
Figure 22E:
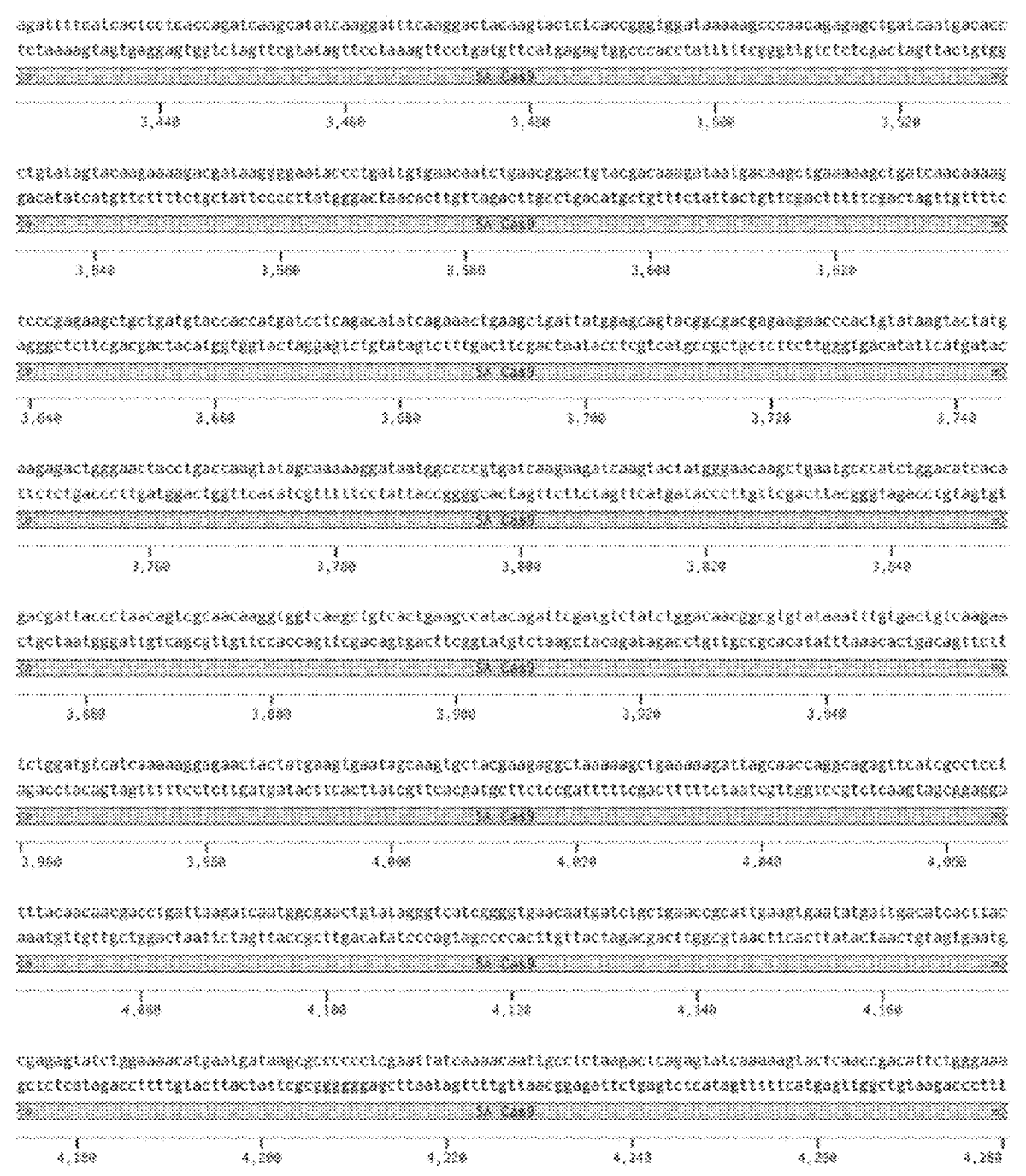
Figure 22F:
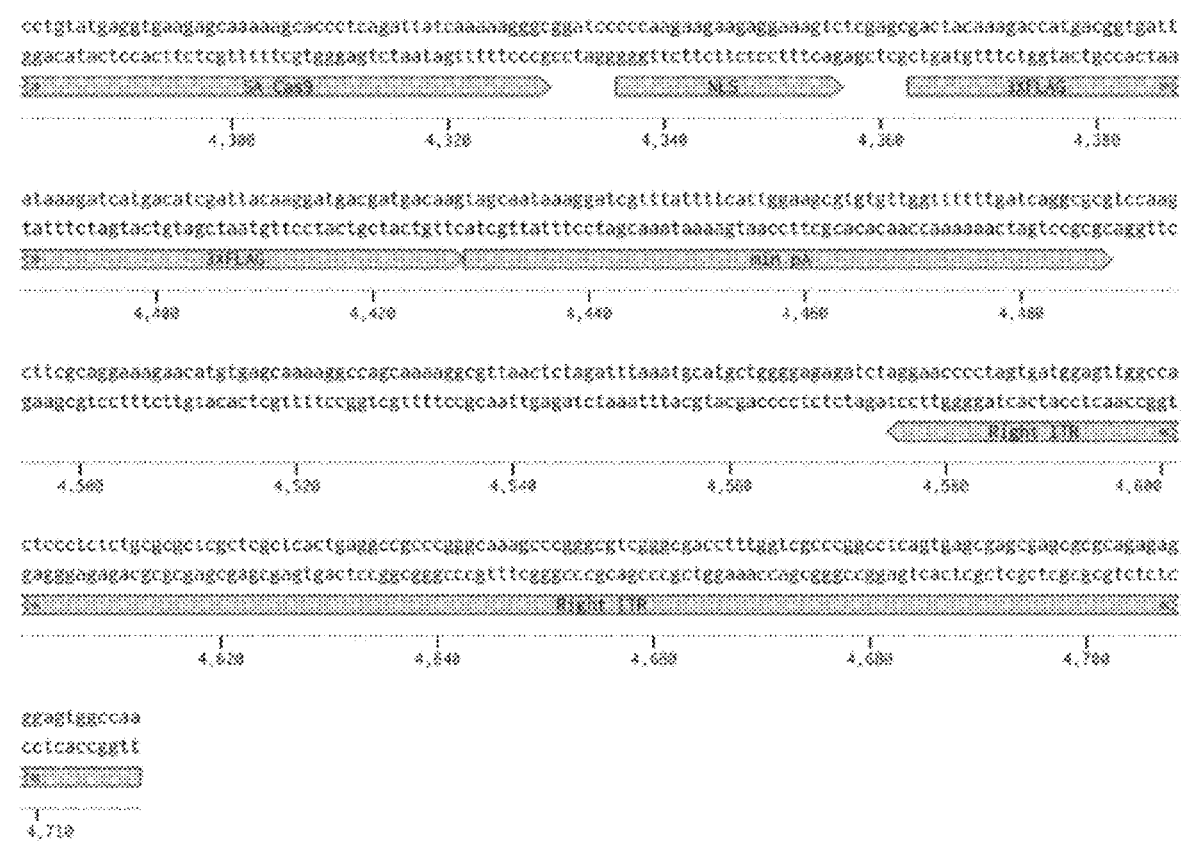

FIGS. 22A-22F depicts the nucleotide sequence of an exemplary recombinant AAV genome containing a CRX promoter. Various components of the recombinant AAV genome are also indicated. N=A, T, G or C. The number of N residues can vary, e.g., from 16 to 26 nucleotides. Upper stand: 5'→6' (SEQ ID NO: 431); lower stand: 3'→6' (SEQ ID NO: 448).

Figure 23A:
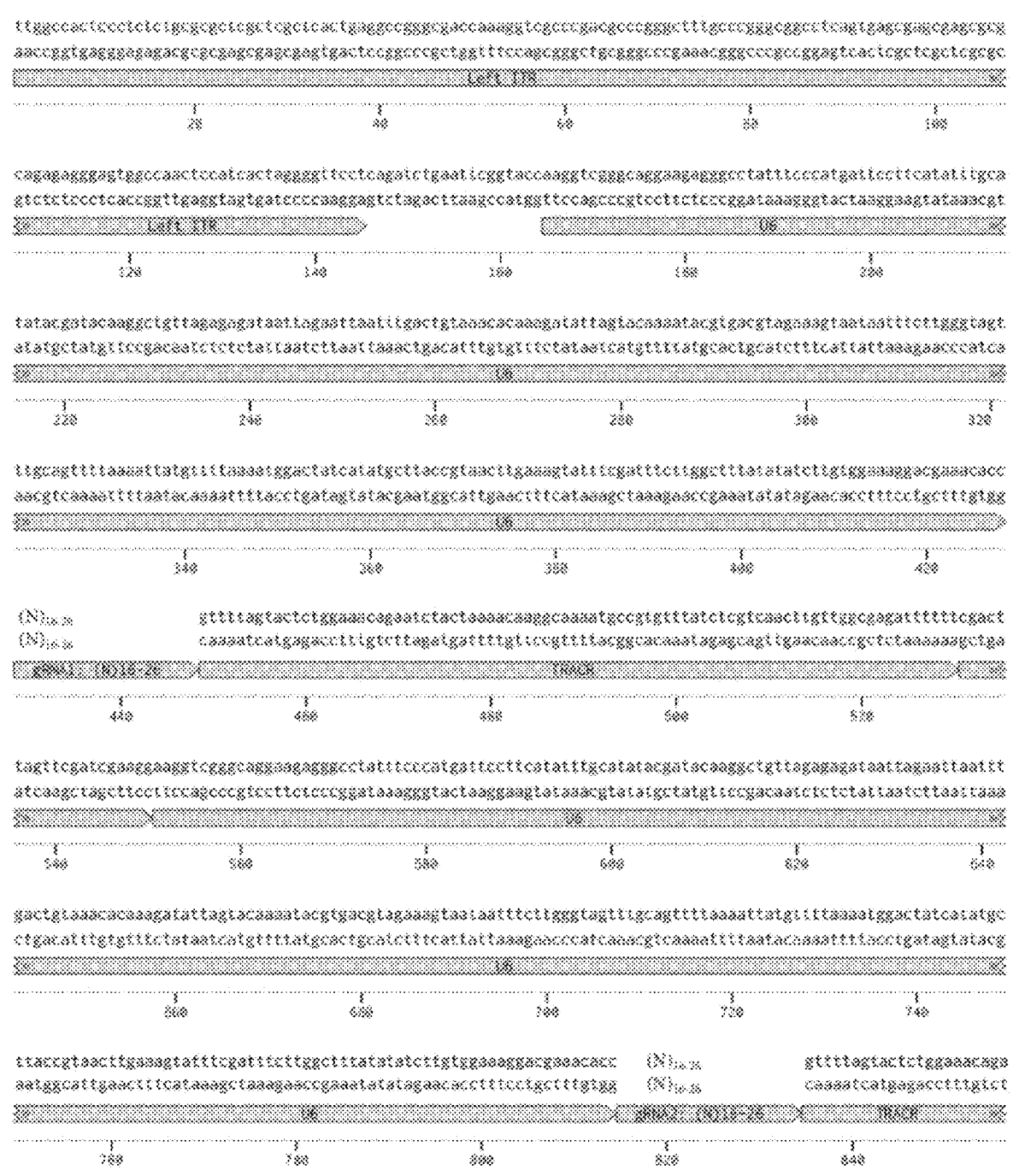
Figure 23B:
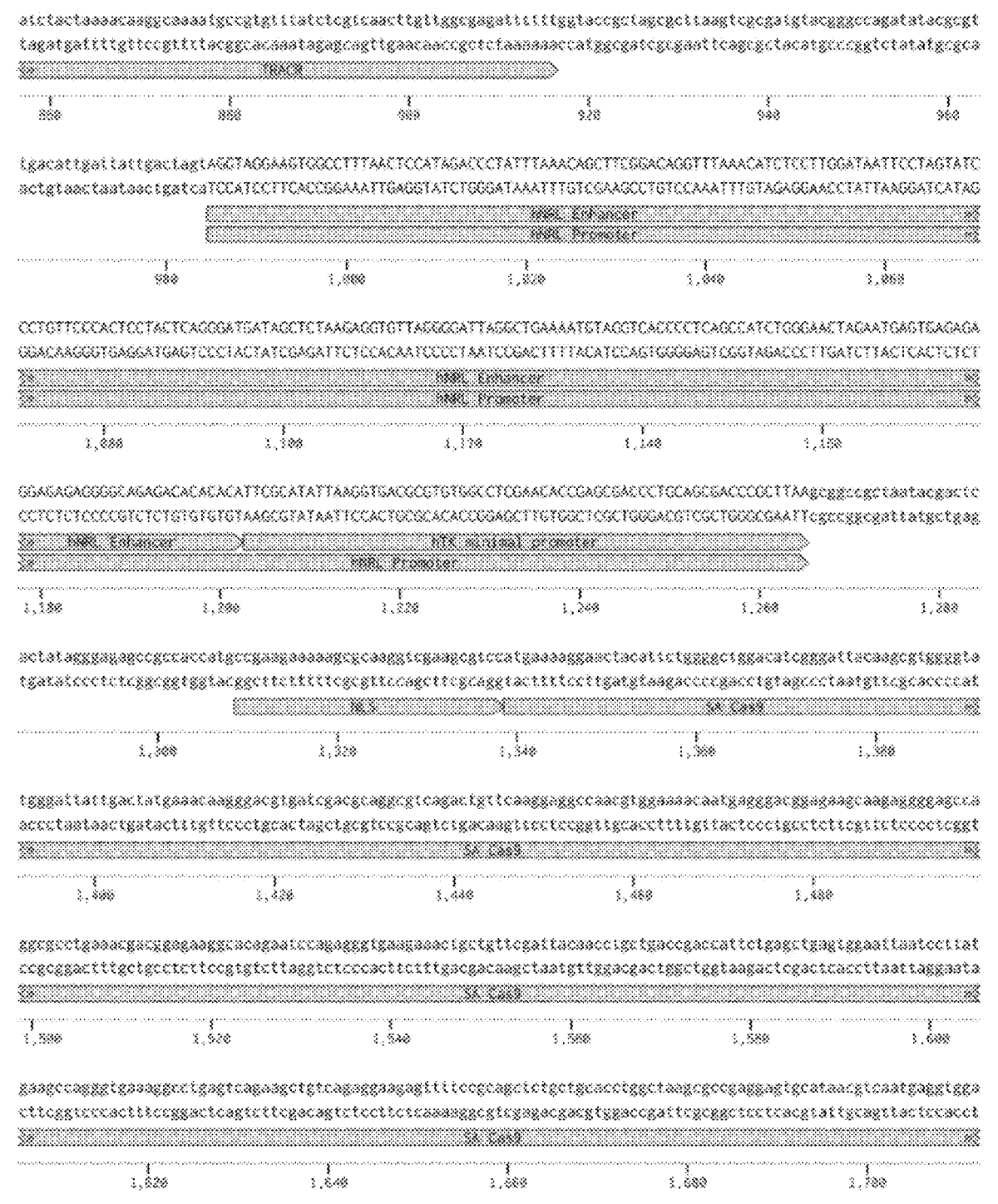
Figure 23C:
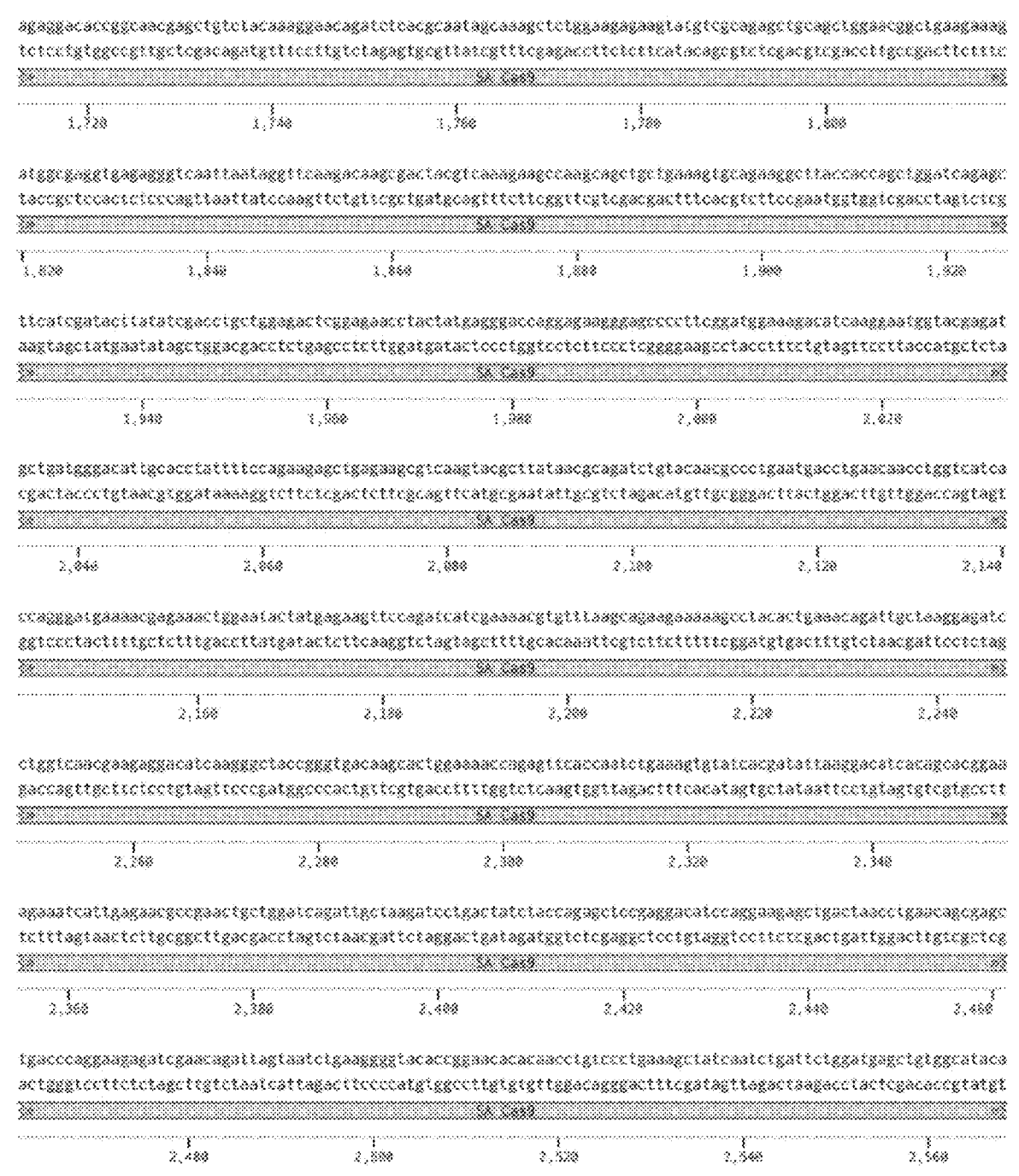
Figure 23D:
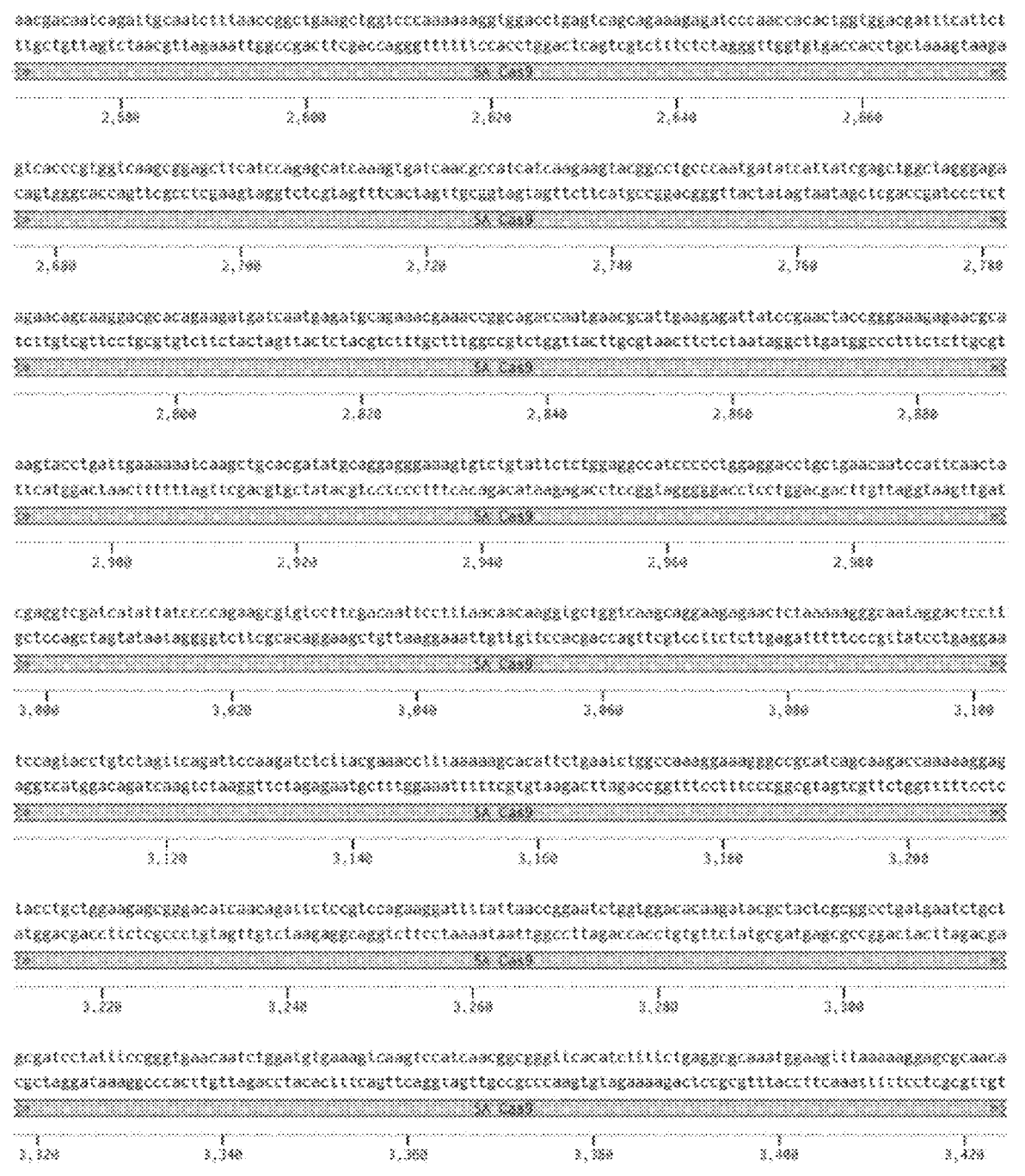
Figure 23E:
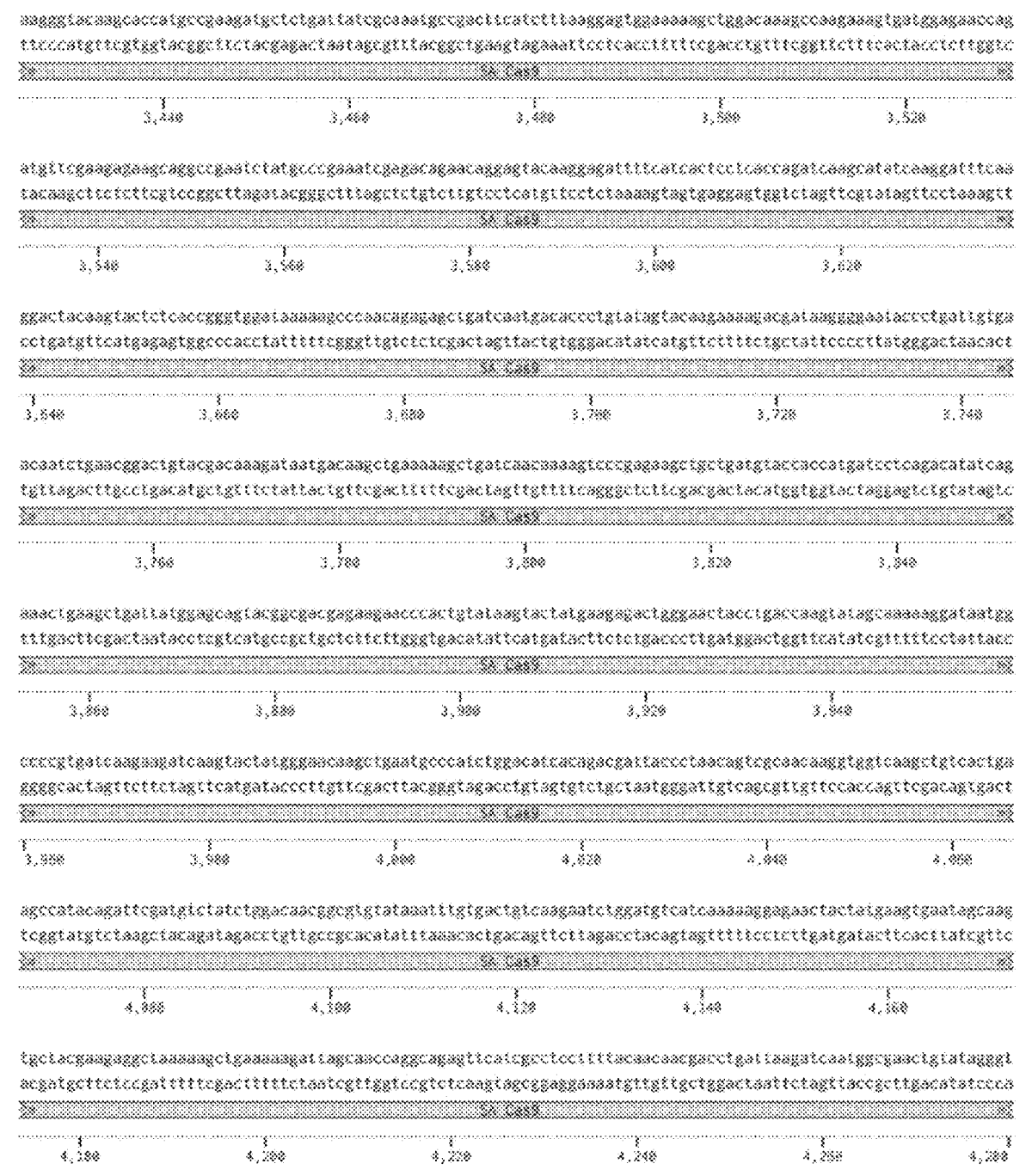
Figure 23F:
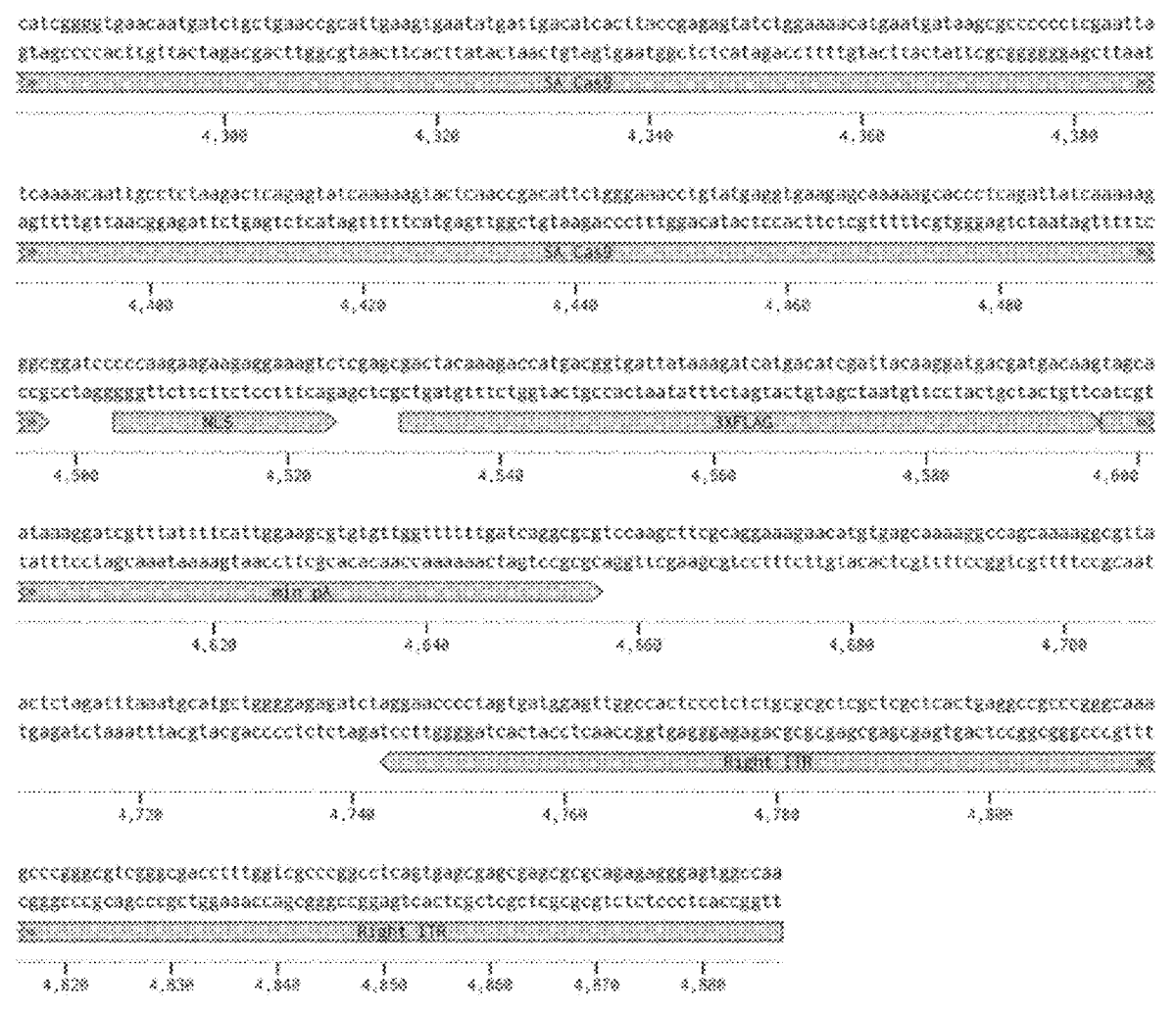

FIGS. 23A-23F depicts the nucleotide sequence of an exemplary recombinant AAV genome containing a NRL promoter. Various components of the recombinant AAV genome are also indicated. N=A, T, G or C. The number of N residues can vary, e.g., from 16 to 26 nucleotides. Upper stand: 5'→43' (SEQ ID NO: 432); lower stand: 3'→5' (SEQ ID NO: 449).

Figure 24A:
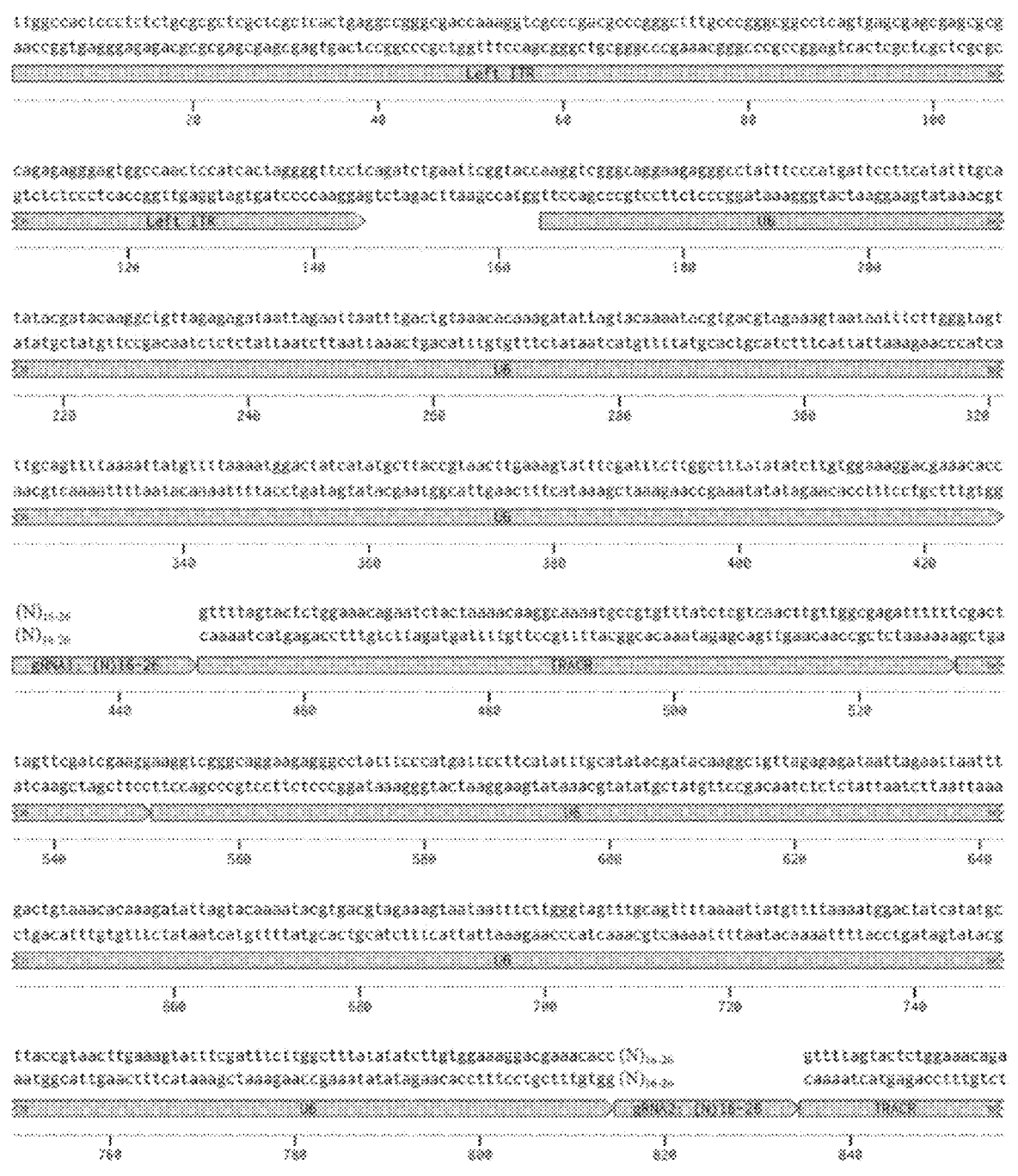
Figure 24B:
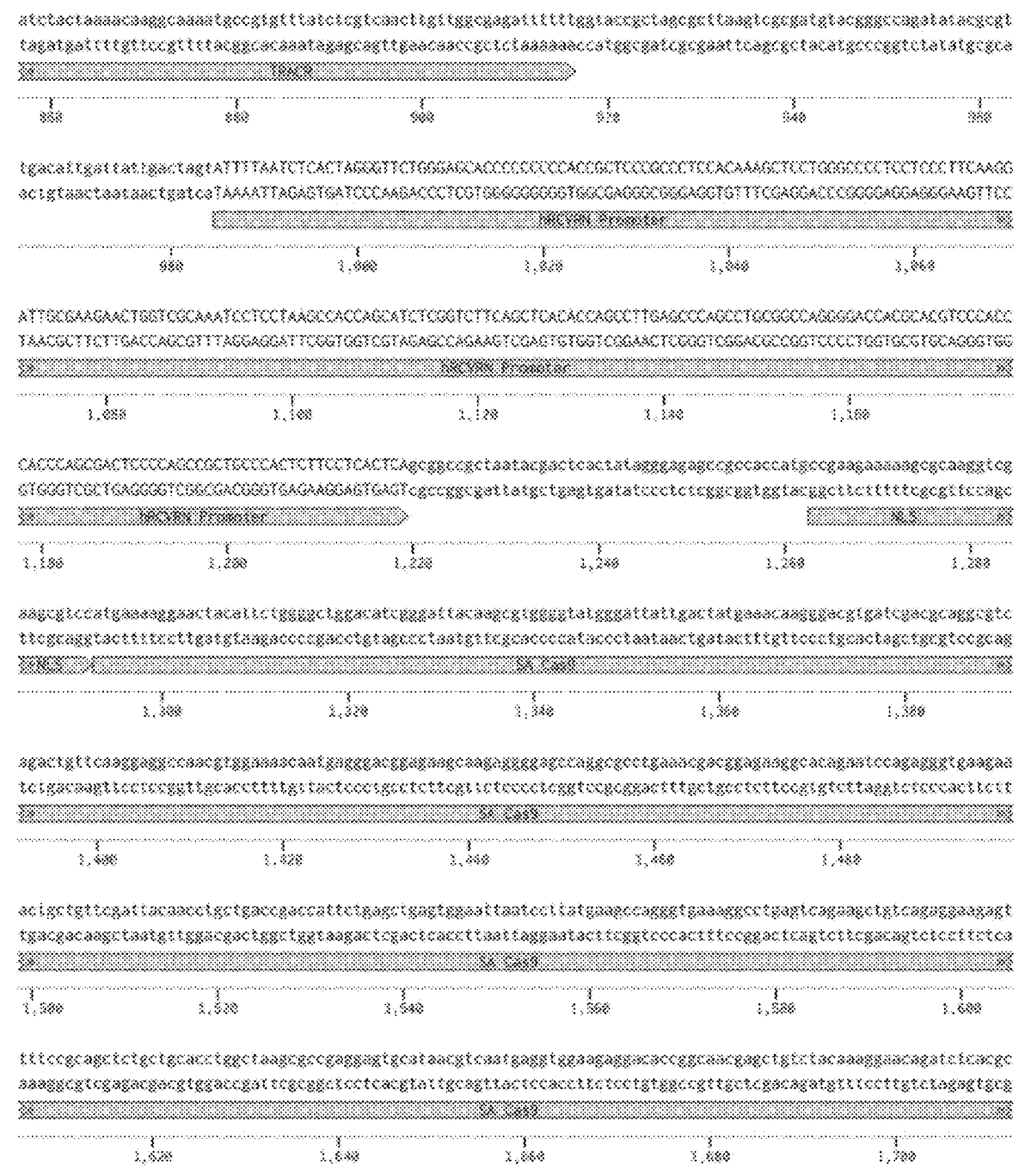
Figure 24C:
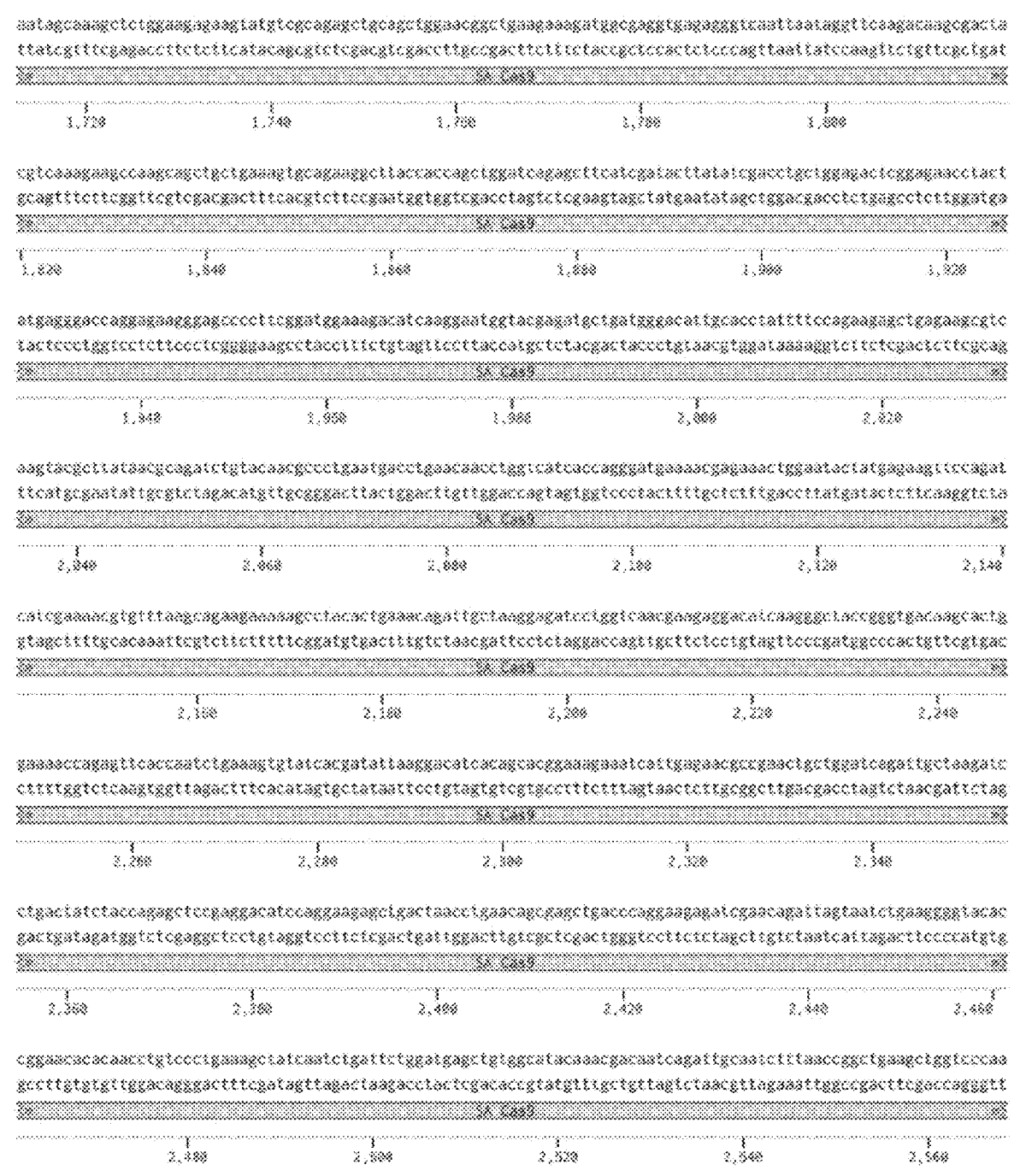
Figure 24D:
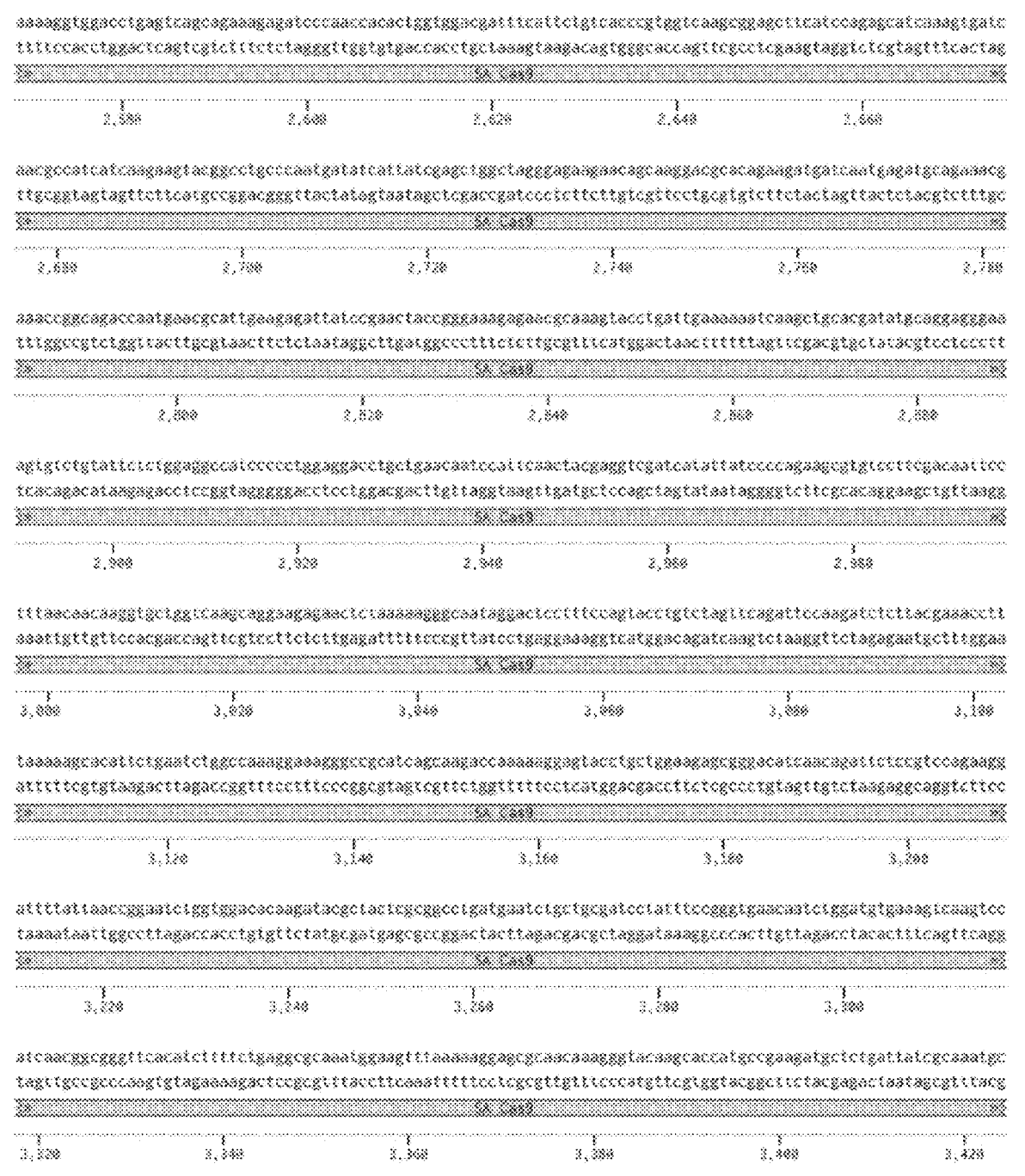
Figure 24E:
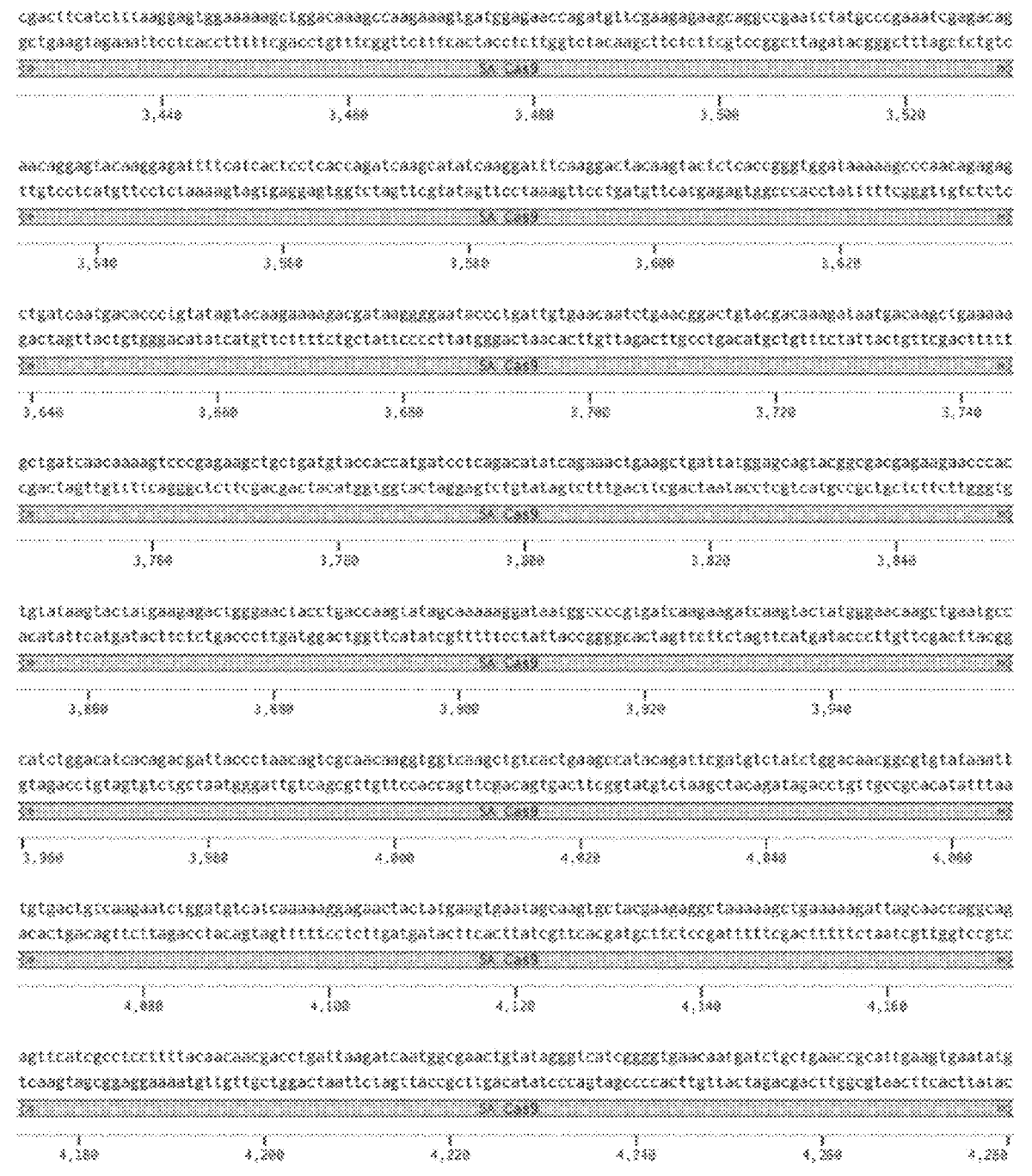
Figure 24F:
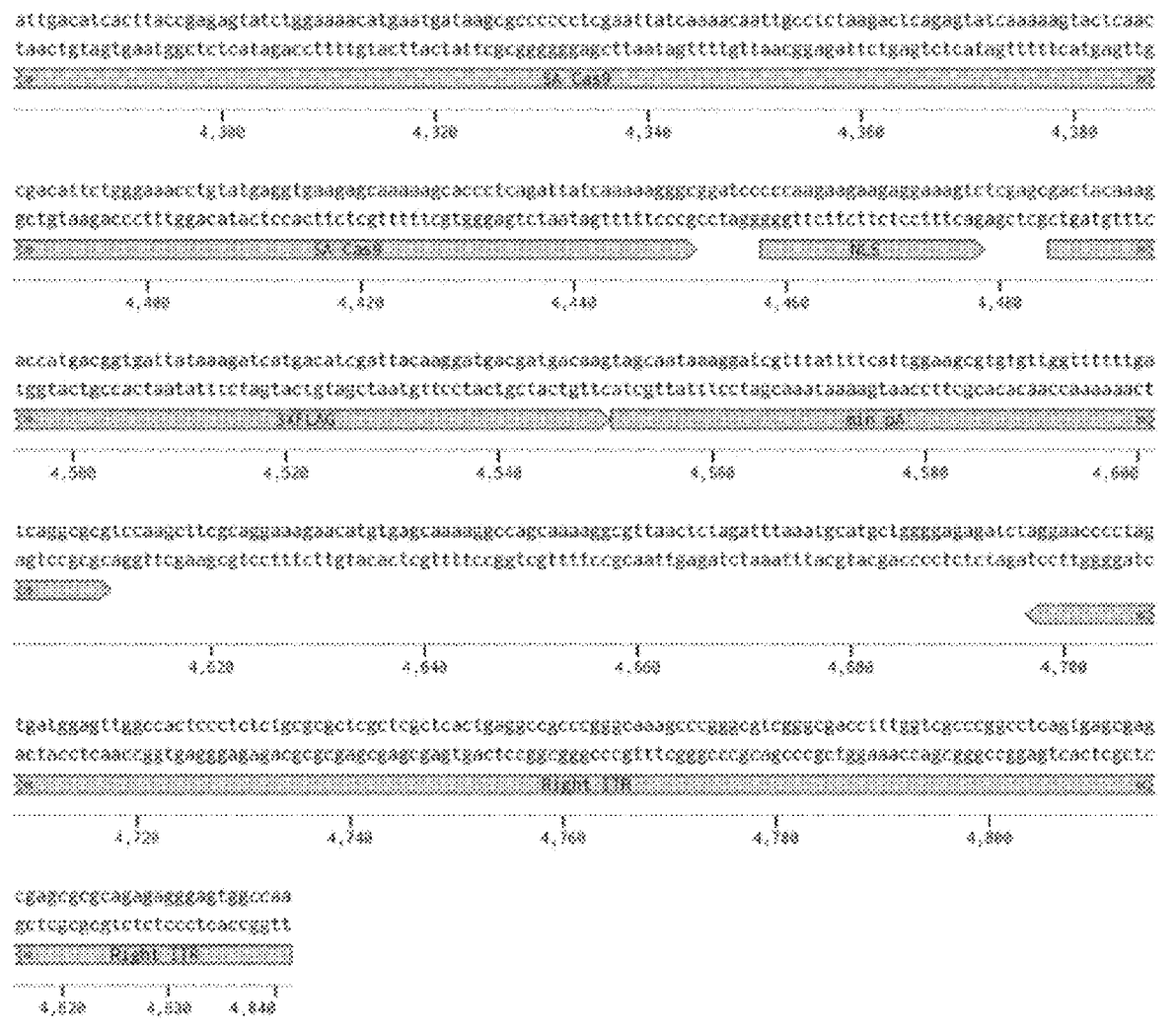

FIGS. 24A-24F depicts the nucleotide sequence of an exemplary recombinant AAV genome containing a NRL promoter. Various components of the recombinant AAV genome are also indicated. N=A, T, G or C. The number of N residues can vary, e.g., from 16 to 26 nucleotides. Upper stand: 5'→6' (SEQ ID NO: 433); lower stand: 3'→5' (SEQ ID NO: 450).

FIG. 25A shows an AAV genome for use in altering a CEP290 target position which encodes, inter alia, two guide RNAs having specific targeting domains selected from SEQ ID NOs: 389-391, 388, 392, and 394 and an *S. aureus* Cas9. FIG. 25B shows an AAV genome that may be used for a variety of applications, including without limitation the alteration of the CEP290 target position, encoding two guide RNAs comprising the sequences of SEQ ID NOs: 2785 and 2787 and an *S. aureus* Cas9. FIG. 25C shows an AAV genome encoding one or two guide RNAs, each driven by a U6 promoter, and an *S. aureus* Cas9. In the figure, N may be 1 or two.

DETAILED DESCRIPTION

Definitions

Figure 1A:
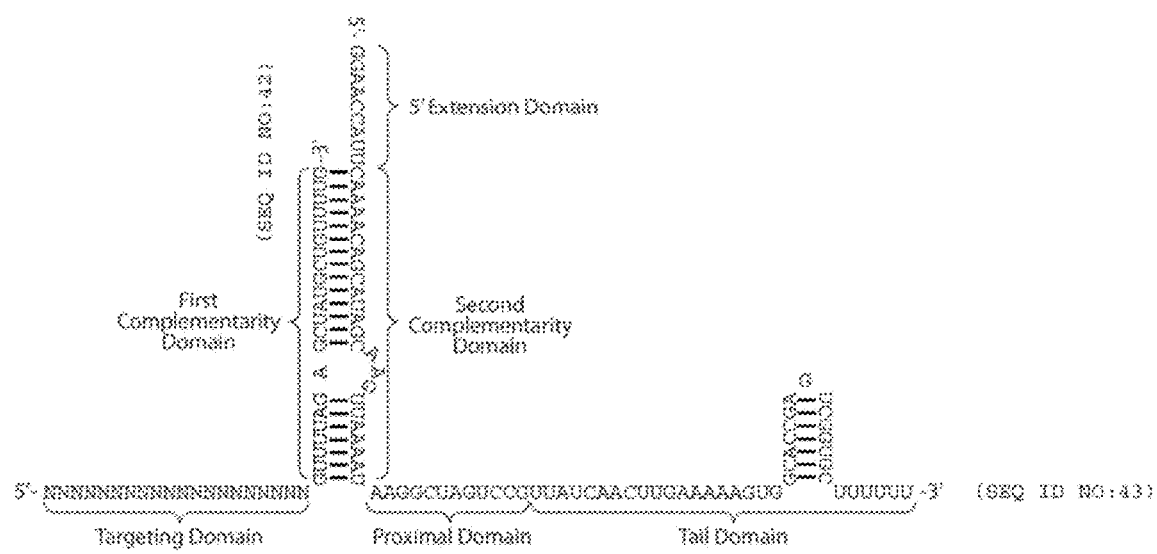

Unless otherwise specified, each of the following terms has the meaning set forth in this section.

The indefinite articles "a" and "an" denote at least one of the associated noun, and are used interchangeably with the terms "at least one" and "one or more." For example, the phrase "a module" means at least one module, or one or more modules.

The conjunctions "or" and "and/or" are used interchangeably.

"Domain" as used herein is used to describe segments of a protein or nucleic acid. Unless otherwise indicated, a domain is not required to have any specific functional property.

An "indel" is an insertion and/or deletion in a nucleic acid sequence. An indel may be the product of the repair of a DNA double strand break, such as a double strand break formed by a genome editing system of the present disclosure. An indel is most commonly formed when a break is repaired by an "error prone" repair pathway such as the NHEJ pathway described below. Indels are typically assessed by sequencing (most commonly by "next-gen" or "sequencing-by-synthesis" methods, though Sanger sequencing may still be used) and are quantified by the relative frequency of numerical changes (e.g., ±1, ±2 or more bases) at a site of interest among all sequencing reads. DNA samples for sequencing can be prepared by a variety of methods known in the art, and may involve the amplification of sites of interest by polymerase chain reaction (PCR) or the capture of DNA ends generated by double strand breaks, as in the GUIDEseq process described in Tsai 2016 (incorporated by reference herein). Other sample preparation methods are known in the art. Indels may also be assessed by other methods, including in situ hybridization methods such as the FiberComb™ system commercialized by Genomic Vision (Bagneux, France), and other methods known in the art.

"CEP290 target position" and "CEP290 target site" are used interchangeably herein to refer to a nucleotide or nucleotides in or near the CEP290 gene that are targeted for alteration using the methods described herein. In certain embodiments, a mutation at one or more of these nucleotides is associated with a CEP290 associated disease. The terms "CEP290 target position" and "CEP290 target site" are also used herein to refer to these mutations. For example, the IVS26 mutation is one non-limiting embodiment of a CEP290 target position/target site.

Calculations of homology or sequence identity between two sequences (the terms are used interchangeably herein) are performed as follows. The sequences are aligned for optimal comparison purposes (e.g., gaps can be introduced in one or both of a first and a second amino acid or nucleic acid sequence for optimal alignment and non-homologous sequences can be disregarded for comparison purposes). The optimal alignment is determined as the best score using the GAP program in the GCG software package with a Blossum 62 scoring matrix with a gap penalty of 12, a gap extend penalty of 4, and a frameshift gap penalty of 5. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position. The percent identity between the two sequences is a function of the number of identical positions shared by the sequences.

"Governing gRNA molecule" as used herein refers to a gRNA molecule that comprises a targeting domain that is complementary to a target domain on a nucleic acid that comprises a sequence that encodes a component of the CRISPR/Cas system that is introduced into a cell or subject. A governing gRNA does not target an endogenous cell or subject sequence. In an embodiment, a governing gRNA molecule comprises a targeting domain that is complementary with a target sequence on: (a) a nucleic acid that encodes a Cas9 molecule; (b) a nucleic acid that encodes a gRNA which comprises a targeting domain that targets the CEP290 gene (a target gene gRNA); or on more than one nucleic acid that encodes a CRISPR/Cas component, e.g., both (a) and (b). In an embodiment, a nucleic acid molecule that encodes a CRISPR/Cas component, e.g., that encodes a Cas9 molecule or a target gene gRNA, comprises more than one target domain that is complementary with a governing gRNA targeting domain. While not wishing to be bound by theory, it is believed that a governing gRNA molecule complexes with a Cas9 molecule and results in Cas9 mediated inactivation of the targeted nucleic acid, e.g., by cleavage or by binding to the nucleic acid, and results in cessation or reduction of the production of a CRISPR/Cas system component. In an embodiment, the Cas9 molecule forms two complexes: a complex comprising a Cas9 molecule with a target gene gRNA, which complex will alter the CEP290 gene; and a complex comprising a Cas9 molecule with a governing gRNA molecule, which complex will act to prevent further production of a CRISPR/Cas system component, e.g., a Cas9 molecule or a target gene gRNA molecule. In an embodiment, a governing gRNA molecule/Cas9 molecule complex binds to or promotes cleavage of a control region sequence, e.g., a promoter, operably linked to a sequence that encodes a Cas9 molecule, a sequence that encodes a transcribed region, an exon, or an intron, for the Cas9 molecule. In an embodiment, a governing gRNA molecule/Cas9 molecule complex binds to or promotes cleavage of a control region sequence, e.g., a promoter, operably linked to a gRNA molecule, or a sequence that encodes the gRNA molecule. In an embodiment, the governing gRNA, e.g., a Cas9-targeting governing gRNA molecule, or a target gene gRNA-targeting governing gRNA molecule, limits the effect of the Cas9 molecule/target gene gRNA molecule complex-mediated gene targeting. In an embodiment, a governing gRNA places temporal, level of expression, or other limits, on activity of the Cas9 molecule/target gene gRNA molecule complex. In an embodiment, a governing gRNA reduces off-target or other unwanted activity. In an embodiment, a governing gRNA molecule inhibits, e.g., entirely or substantially entirely inhibits, the production of a component of the Cas9 system and thereby limits, or governs, its activity.

"Modulator" as used herein refers to an entity, e.g., a drug that can alter the activity (e.g., enzymatic activity, transcriptional activity, or translational activity), amount, distribution, or structure of a subject molecule or genetic sequence. In an embodiment, modulation comprises cleavage, e.g., breaking of a covalent or non-covalent bond, or the forming of a covalent or non-covalent bond, e.g., the attachment of a moiety, to the subject molecule. In an embodiment, a modulator alters the, three dimensional, secondary, tertiary, or quaternary structure, of a subject molecule. A modulator can increase, decrease, initiate, or eliminate a subject activity.

"Large molecule" as used herein refers to a molecule having a molecular weight of at least 2, 3, 5, 10, 20, 30, 40, 50, 60, 70, 80, 90, or 100 kD. Large molecules include proteins, polypeptides, nucleic acids, biologics, and carbohydrates.

"Polypeptide" as used herein refers to a polymer of amino acids having less than 100 amino acid residues. In an embodiment, it has less than 50, 20, or 10 amino acid residues.

"Non-homologous end joining" or "NHEJ", as used herein, refers to ligation mediated repair and/or non-template mediated repair including, e.g., canonical NHEJ (cNHEJ), alternative NHEJ (altNHEJ), microhomology-mediated end joining (MMEJ), single-strand annealing (SSA), and synthesis-dependent microhomology-mediated end joining (SD-MMEJ).

"Reference molecule", e.g., a reference Cas9 molecule or reference gRNA, as used herein refers to a molecule to which a subject molecule, e.g., a subject Cas9 molecule of subject gRNA molecule, e.g., a modified or candidate Cas9 molecule is compared. For example, a Cas9 molecule can be characterized as having no more than 10% of the nuclease activity of a reference Cas9 molecule. Examples of reference Cas9 molecules include naturally occurring unmodified Cas9 molecules, e.g., a naturally occurring Cas9 molecule such as a Cas9 molecule of *S. pyogenes, S. aureus*, or *S. thermophilus*. In an embodiment, the reference Cas9 molecule is the naturally occurring Cas9 molecule having the closest sequence identity or homology with the Cas9 molecule to which it is being compared. In an embodiment, the reference Cas9 molecule is a sequence, e.g., a naturally occurring or known sequence, which is the parental form on which a change, e.g., a mutation has been made.

"Replacement", or "replaced", as used herein with reference to a modification of a molecule does not require a process limitation but merely indicates that the replacement entity is present.

"Small molecule" as used herein refers to a compound having a molecular weight less than about 2 kD, e.g., less than about 2 kD, less than about 1.5 kD, less than about 1 kD, or less than about 0.75 kD.

"Subject" as used herein means a human, mouse, or non-human primate. A human subject can be any age (e.g., an infant, child, young adult, or adult), and may suffer from a disease, or may be in need of alteration of a gene.

"Treat," "treating," and "treatment" as used herein mean the treatment of a disease in a subject (e.g., a human subject), including one or more of inhibiting the disease, i.e., arresting or preventing its development or progression; relieving the disease, i.e., causing regression of the disease state; relieving one or more symptoms of the disease; and curing the disease.

"Prevent," "preventing," and "prevention" as used herein means the prevention of a disease in a subject, e.g., in a human, including (a) avoiding or precluding the disease; (b) affecting the predisposition toward the disease; (c) preventing or delaying the onset of at least one symptom of the disease.

The terms "polynucleotide", "nucleotide sequence", "nucleic acid", "nucleic acid molecule", "nucleic acid sequence", and "oligonucleotide" as used herein refer to a series of nucleotide bases (also called "nucleotides") in DNA and RNA, and mean any chain of two or more nucleotides. The polynucleotides can be chimeric mixtures or derivatives or modified versions thereof, single-stranded or double-stranded. The oligonucleotide can be modified at the base moiety, sugar moiety, or phosphate backbone, for example, to improve stability of the molecule, its hybridization parameters, etc. A nucleotide sequence typically carries genetic information, including the information used by cellular machinery to make proteins and enzymes. These terms include double- or single-stranded genomic DNA, RNA, any synthetic and genetically manipulated polynucleotide, and both sense and antisense polynucleotides. This also includes nucleic acids containing modified bases.

"X" as used herein in the context of an amino acid sequence, refers to any amino acid (e.g., any of the twenty natural amino acids) unless otherwise specified.

Conventional IUPAC notation is used in nucleotide sequences presented herein, as shown in Table 1, below (see also Cornish-Bowden 1985, incorporated by reference herein). It should be noted, however, that "T" denotes "Thymine or Uracil" insofar as a given sequence (such as a gRNA sequence) may be encoded by either DNA or RNA.

TABLE 1

| IUPAC nucleic acid notation | |
| --- | --- |
| Character | Base |
| A | Adenine |
| T | Thymine |
| G | Guanine |
| C | Cytosine |
| U | Uracil |
| K | G or T/U |
| M | A or C |
| R | A or G |
| Y | C or T/U |
| S | C or G |
| W | A or T/U |

TABLE 1-continued

| IUPAC nucleic acid notation | |
| --- | --- |
| Character | Base |
| B | C, G, or T/U |
| V | A, C, or G |
| H | A, C, or T/U |
| D | A, G, or T/U |
| N | A, C, G, or T/U |

The terms "protein," "peptide" and "polypeptide" are used interchangeably herein to refer to a sequential chain of amino acids linked together via peptide bonds. The terms include individual proteins, groups or complexes of proteins that associate together, as well as fragments, variants, derivatives and analogs of such proteins. Peptide sequences are presented using conventional notation, beginning with the amino or N-terminus on the left, and proceeding to the carboxyl or C-terminus on the right. Standard one-letter or three-letter abbreviations may be used.

Methods of Altering CEP290

CEP290 encodes a centrosomal protein that plays a role in centrosome and cilia development. The CEP290 gene is involved in forming cilia around cells, particularly in the photoreceptors at the back of the retina, which are needed to detect light and color.

Disclosed herein are methods and compositions for altering the LCA10 target position in the CEP290 gene. LCA10 target position can be altered (e.g., corrected) by gene editing, e.g., using CRISPR-Cas9 mediated methods. The alteration (e.g., correction) of the mutant CEP290 gene can be mediated by any mechanism. Exemplary mechanisms that can be associated with the alteration (e.g., correction) of the mutant CEP290 gene include, but are not limited to, non-homologous end joining (e.g., classical or alternative), microhomology-mediated end joining (MMEJ), homology-directed repair (e.g., endogenous donor template mediated), SDSA (synthesis dependent strand annealing), single strand annealing or single strand invasion. Methods described herein introduce one or more breaks near the site of the LCA target position (e.g., c.2991+1655A to G) in at least one allele of the CEP290 gene. In an embodiment, the one or more breaks are repaired by NHEJ. During repair of the one or more breaks, DNA sequences are inserted and/or deleted resulting in the loss or destruction of the cryptic splice site resulting from the mutation at the LCA10 target position (e.g., c.2991+1655A to G). The method can include acquiring knowledge of the mutation carried by the subject, e.g., by sequencing the appropriate portion of the CEP290 gene.

Altering the LCA10 target position refers to (1) break-induced introduction of an indel (also referred to herein as NHEJ-mediated introduction of an indel) in close proximity to or including a LCA10 target position (e.g., c.2991+1655A to G), or (2) break-induced deletion (also referred to herein as NHEJ-mediated deletion) of genomic sequence including the mutation at a LCA10 target position (e.g., c.2991+1655A to G). Both approaches give rise to the loss or destruction of the cryptic splice site.

Figure 9A:
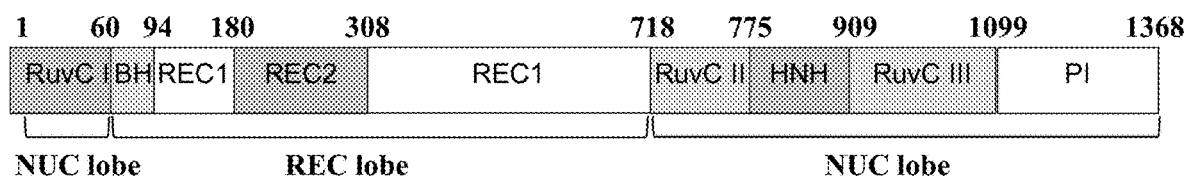
FIGS. 9A-9B are schematic representations of the domain organization of S. pyogenes Cas 9.
Figure 9B:
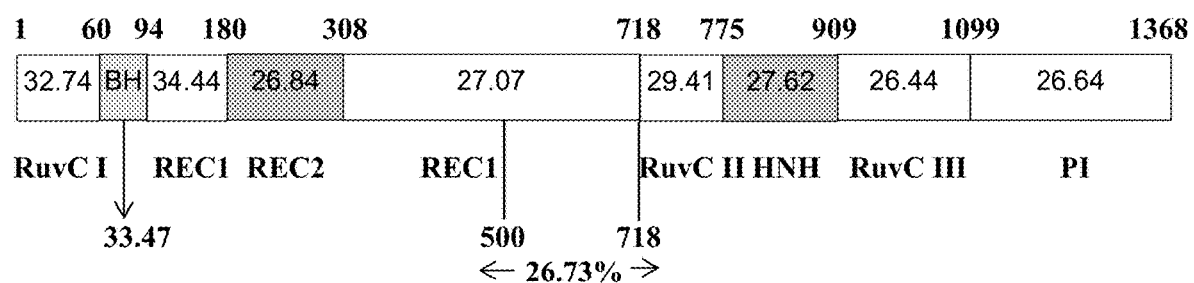

In an embodiment, the method comprises introducing a break-induced indel in close proximity to or including the LCA10 target position (e.g., c.2991+1655A to G). As described herein, in one embodiment, the method comprises the introduction of a double strand break sufficiently close to (e.g., either 5' or 3' to) the LCA10 target position, e.g., c.2991+1655A to G, such that the break-induced indel could be reasonably expected to span the mutation. A single gRNAs, e.g., unimolecular (or chimeric) or modular gRNA molecules, is configured to position a double strand break sufficiently close to the LCA10 target position in the CEP290 gene. In an embodiment, the break is positioned to avoid unwanted target chromosome elements, such as repeat elements, e.g., an Alu repeat. The double strand break may be positioned within 40 nucleotides (e.g., within 1, 2, 3, 4, 5, 10, 15, 16, 17, 18, 19, 20, 25, 30, 35 or 40 nucleotides) upstream of the LCA10 target position, or within 40 nucleotides (e.g., within 1, 2, 3, 4, 5, 10, 15, 16, 17, 18, 19, 20, 25, 30, 35 or 40 nucleotides) downstream of the LCA10 target position (see FIG. 9). While not wishing to be bound by theory, in an embodiment, it is believed that NHEJ-mediated repair of the double strand break allows for the NHEJ-mediated introduction of an indel in close proximity to or including the LCA10 target position.

In another embodiment, the method comprises the introduction of a pair of single strand breaks sufficiently close to (either 5' or 3' to, respectively) the mutation at the LCA10 target position (e.g., c.2991+1655A to G) such that the break-induced indel could be reasonably expected to span the mutation. Two gRNAs, e.g., unimolecular (or chimeric) or modular gRNA molecules, are configured to position the two single strand breaks sufficiently close to the LCA10 target position in the CEP290 gene. In an embodiment, the breaks are positioned to avoid unwanted target chromosome elements, such as repeat elements, e.g., an Alu repeat. In an embodiment, the pair of single strand breaks is positioned within 40 nucleotides (e.g., within 1, 2, 3, 4, 5, 10, 15, 16, 17, 18, 19, 20, 25, 30, 35 or 40 nucleotides) upstream of the LCA10 target position, or within 40 nucleotides (e.g., within 1, 2, 3, 4, 5, 10, 15, 16, 17, 18, 19, 20, 25, 30, 35 or 40 nucleotides) downstream of the LCA10 target position (see FIG. 9). While not wishing to be bound by theory, in an embodiment, it is believed that NHEJ mediated repair of the pair of single strand breaks allows for the NHEJ-mediated introduction of an indel in close proximity to or including the LCA10 target position. In an embodiment, the pair of single strand breaks may be accompanied by an additional double strand break, positioned by a third gRNA molecule, as is discussed below. In another embodiment, the pair of single strand breaks may be accompanied by two additional single strand breaks positioned by a third gRNA molecule and a fourth gRNA molecule, as is discussed below.

Figure 10:
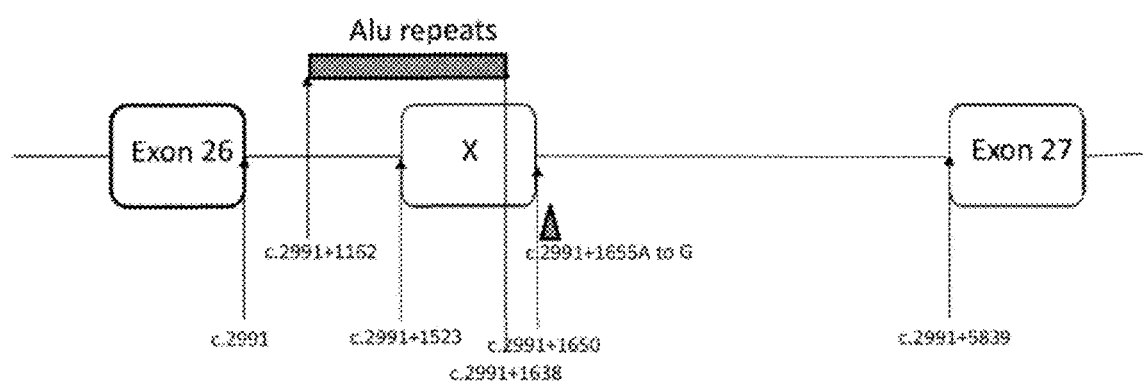
FIG. 10 shows the nucleotide locations of the Alu repeats, cryptic exon and point mutation, c.2991+1655 A to G in the human CEP290 locus. "X" indicates the cryptic exon. The blue triangle indicates the LCA target position c.2991+1655A to G.

In an embodiment, the method comprises introducing a break-induced deletion of genomic sequence including the mutation at the LCA10 target position (e.g., c.2991+1655A to G). As described herein, in one embodiment, the method comprises the introduction of two double strand breaks—one 5' and the other 3' to (i.e., flanking) the LCA10 target position. Two gRNAs, e.g., unimolecular (or chimeric) or modular gRNA molecules, are configured to position the two double strand breaks on opposite sides of the LCA10 target position in the CEP290 gene. In an embodiment, the first double strand break is positioned upstream of the LCA10 target position within intron 26 (e.g., within 1654 nucleotides), and the second double strand break is positioned downstream of the LCA10 target position within intron 26 (e.g., within 4183 nucleotides) (see FIG. 10). In an embodiment, the breaks (i.e., the two double strand breaks) are positioned to avoid unwanted target chromosome elements, such as repeat elements, e.g., an Alu repeat, or the endogenous CEP290 splice sites.

The first double strand break may be positioned as follows:
(1) upstream of the 5' end of the Alu repeat in intron 26,
(2) between the 3' end of the Alu repeat and the LCA10 target position in intron 26, or
(3) within the Alu repeat provided that a sufficient length of the gRNA fall outside of the repeat so as to avoid binding to other Alu repeats in the genome, and the second double strand break to be paired with the first double strand break may be positioned downstream of the LCA10 target position in intron 26.

For example, the first double strand break may be positioned:
(1) within 1162 nucleotides upstream of the 5' end of the Alu repeat,
(2) within 1000 nucleotides upstream of the 5' end of the Alu repeat,
(3) within 900 nucleotides upstream of the 5' end of the Alu repeat,
(4) within 800 nucleotides upstream of the 5' end of the Alu repeat,
(5) within 700 nucleotides upstream of the 5' end of the Alu repeat,
(6) within 600 nucleotides upstream of the 5' end of the Alu repeat,
(7) within 500 nucleotides upstream of the 5' end of the Alu repeat,
(8) within 400 nucleotides upstream of the 5' end of the Alu repeat,
(9) within 300 nucleotides upstream of the 5' end of the Alu repeat,
(10) within 200 nucleotides upstream of the 5' end of the Alu repeat,
(11) within 100 nucleotides upstream of the 5' end of the Alu repeat,
(12) within 50 nucleotides upstream of the 5' end of the Alu repeat,
(13) within the Alu repeat provided that a sufficient length of the gRNA falls outside of the repeat so as to avoid binding to other Alu repeats in the genome,
(14) within 40 nucleotides (e.g., within 1, 2, 3, 4, 5, 10, 15, 16, 17, 18, 19, 20, 25, 30, 35 or 40 nucleotides) upstream of the LCA10 target position, or
(15) within 17 nucleotides (e.g., within 1, 2, 3, 4, 5, 10, 15, 16 or 17 nucleotides) upstream of the LCA10 target position, and the second double strand breaks to be paired with the first double strand break may be positioned:
(1) within 4183 nucleotides downstream of the LCA10 target position,
(2) within 4000 nucleotides downstream of the LCA10 target position,
(3) within 3000 nucleotides downstream of the LCA10 target position,
(4) within 2000 nucleotides downstream of the LCA10 target position,
(5) within 1000 nucleotides downstream of the LCA10 target position,
(6) within 700 nucleotides downstream of the LCA10 target position,
(7) within 500 nucleotides downstream of the LCA10 target position,
(8) within 300 nucleotides downstream of the LCA10 target position,
(9) within 100 nucleotides downstream of the LCA10 target position,

(10) within 60 nucleotides downstream of the LCA10 target position, or
(11) within 40 (e.g., 1, 2, 3, 4, 5, 10, 15, 20, 25, 30, 35 or 40 nucleotides) nucleotides downstream of the LCA10 target position.

While not wishing to be bound by theory, in an embodiment, it is believed that the two double strand breaks allow for break-induced deletion of genomic sequence including the mutation at the LCA10 target position in the CEP290 gene.

The method also comprises the introduction of two sets of breaks, e.g., one double strand break (either 5' or 3' to the mutation at the LCA10 target position, e.g., c.2991+1655A to G) and a pair of single strand breaks (on the other side of the LCA10 target position opposite from the double strand break) such that the two sets of breaks are positioned to flank the LCA10 target position. Three gRNAs, e.g., unimolecular (or chimeric) or modular gRNA molecules, are configured to position the one double strand break and the pair of single strand breaks on opposite sides of the LCA10 target position in the CEP290 gene. In an embodiment, the first set of breaks (either the double strand break or the pair of single strand breaks) is positioned upstream of the LCA10 target position within intron 26 (e.g., within 1654 nucleotides), and the second set of breaks (either the double strand break or the pair of single strand breaks) are positioned downstream of the LCA10 target position within intron 26 (e.g., within 4183 nucleotides) (see FIG. 10). In an embodiment, the two sets of breaks (i.e., the double strand break and the pair of single strand breaks) are positioned to avoid unwanted target chromosome elements, such as repeat elements, e.g., an Alu repeat, or the endogenous CEP290 splice sites.

The first set of breaks (either the double strand break or the pair of single strand breaks) may be positioned:
(1) upstream of the 5' end of the Alu repeat in intron 26,
(2) between the 3' end of the Alu repeat and the LCA10 target position in intron 26, or
(3) within the Alu repeat provided that a sufficient length of the gRNA falls outside of the repeat so as to avoid binding to other Alu repeats in the genome,
and the second set of breaks to be paired with the first set of breaks (either the double strand break or the pair of single strand breaks) may be positioned downstream of the LCA10 target position in intron 26.

For example, the first set of breaks (either the double strand break or the pair of single strand breaks) may be positioned:
(1) within 1162 nucleotides upstream of the 5' end of the Alu repeat,
(2) within 1000 nucleotides upstream of the 5' end of the Alu repeat,
(3) within 900 nucleotides upstream of the 5' end of the Alu repeat,
(4) within 800 nucleotides upstream of the 5' end of the Alu repeat,
(5) within 700 nucleotides upstream of the 5' end of the Alu repeat,
(6) within 600 nucleotides upstream of the 5' end of the Alu repeat,
(7) within 500 nucleotides upstream of the 5' end of the Alu repeat,
(8) within 400 nucleotides upstream of the 5' end of the Alu repeat,
(9) within 300 nucleotides upstream of the 5' end of the Alu repeat,
(10) within 200 nucleotides upstream of the 5' end of the Alu repeat,
(11) within 100 nucleotides upstream of the 5' end of the Alu repeat,
(12) within 50 nucleotides upstream of the 5' end of the Alu repeat,
(13) within the Alu repeat provided that a sufficient length of the gRNA falls outside of the repeat so as to avoid binding to other Alu repeats in the genome,
(14) within 40 nucleotides (e.g., within 1, 2, 3, 4, 5, 10, 15, 16, 17, 18, 19, 20, 25, 30, 35 or 40 nucleotides) upstream of the LCA10 target position, or
(15) within 17 nucleotides (e.g., within 1, 2, 3, 4, 5, 10, 15, 16 or 17 nucleotides) upstream of the LCA10 target position,
and the second set of breaks to be paired with the first set of breaks (either the double strand break or the pair of single strand breaks) may be positioned:
(1) within 4183 nucleotides downstream of the LCA10 target position,
(2) within 4000 nucleotides downstream of the LCA10 target position,
(3) within 3000 nucleotides downstream of the LCA10 target position,
(4) within 2000 nucleotides downstream of the LCA10 target position,
(5) within 1000 nucleotides downstream of the LCA10 target position,
(6) within 700 nucleotides downstream of the LCA10 target position,
(7) within 500 nucleotides downstream of the LCA10 target position,
(8) within 300 nucleotides downstream of the LCA10 target position,
(9) within 100 nucleotides downstream of the LCA10 target position,
(10) within 60 nucleotides downstream of the LCA10 target position, or
(11) within 40 (e.g., 1, 2, 3, 4, 5, 10, 15, 20, 25, 30, 35 or 40 nucleotides) nucleotides downstream of the LCA10 target position.

While not wishing to be bound by theory, it is believed that the two sets of breaks (either the double strand break or the pair of single strand breaks) allow for break-induced deletion of genomic sequence including the mutation at the LCA10 target position in the CEP290 gene.

The method also comprises the introduction of two sets of breaks, e.g., two pairs of single strand breaks, wherein the two sets of single-stranded breaks are positioned to flank the LCA10 target position. In an embodiment, the first set of breaks (e.g., the first pair of single strand breaks) is 5' to the mutation at the LCA10 target position (e.g., c.2991+1655A to G) and the second set of breaks (e.g., the second pair of single strand breaks) is 3' to the mutation at the LCA10 target position. Four gRNAs, e.g., unimolecular (or chimeric) or modular gRNA molecules, are configured to position the two pairs of single strand breaks on opposite sides of the LCA10 target position in the CEP290 gene. In an embodiment, the first set of breaks (e.g., the first pair of single strand breaks) is positioned upstream of the LCA10 target position within intron 26 (e.g., within 1654 nucleotides), and the second set of breaks (e.g., the second pair of single strand breaks) is positioned downstream of the LCA10 target position within intron 26 (e.g., within 4183 nucleotides) (see FIG. 10). In an embodiment, the two sets of breaks (i.e., the two pairs of single strand breaks) are positioned to avoid unwanted target chromosome elements, such as repeat elements, e.g., an Alu repeat, or the endogenous CEP290 splice sites.

The first set of breaks (e.g., the first pair of single strand breaks) may be positioned:
(1) upstream of the 5' end of the Alu repeat in intron 26,
(2) between the 3' end of the Alu repeat and the LCA10 target position in intron 26, or
(3) within the Alu repeat provided that a sufficient length of the gRNA falls outside of the repeat so as to avoid binding to other Alu repeats in the genome, and the second set of breaks to be paired with the first set of breaks (e.g., the second pair of single strand breaks) may be positioned downstream of the LCA10 target position in intron 26.

For example, the first set of breaks (e.g., the first pair of single strand breaks) may be positioned:
(1) within 1162 nucleotides upstream of the 5' end of the Alu repeat,
(2) within 1000 nucleotides upstream of the 5' end of the Alu repeat,
(3) within 900 nucleotides upstream of the 5' end of the Alu repeat,
(4) within 800 nucleotides upstream of the 5' end of the Alu repeat,
(5) within 700 nucleotides upstream of the 5' end of the Alu repeat,
(6) within 600 nucleotides upstream of the 5' end of the Alu repeat,
(7) within 500 nucleotides upstream of the 5' end of the Alu repeat,
(8) within 400 nucleotides upstream of the 5' end of the Alu repeat,
(9) within 300 nucleotides upstream of the 5' end of the Alu repeat,
(10) within 200 nucleotides upstream of the 5' end of the Alu repeat,
(11) within 100 nucleotides upstream of the 5' end of the Alu repeat,
(12) within 50 nucleotides upstream of the 5' end of the Alu repeat,
(13) within the Alu repeat provided that a sufficient length of the gRNA falls outside of the repeat so as to avoid binding to other Alu repeats in the genome,
(14) within 40 nucleotides (e.g., within 1, 2, 3, 4, 5, 10, 15, 16, 17, 18, 19, 20, 25, 30, 35 or 40 nucleotides) upstream of the LCA10 target position, or
(15) within 17 nucleotides (e.g., within 1, 2, 3, 4, 5, 10, 15, 16 or 17 nucleotides) upstream of the LCA10 target position, and the second set of breaks to be paired with the first set of breaks (e.g., the second pair of single strand breaks) may be positioned:
(1) within 4183 nucleotides downstream of the LCA10 target position,
(2) within 4000 nucleotides downstream of the LCA10 target position,
(3) within 3000 nucleotides downstream of the LCA10 target position,
(4) within 2000 nucleotides downstream of the LCA10 target position,
(5) within 1000 nucleotides downstream of the LCA10 target position,
(6) within 700 nucleotides downstream of the LCA10 target position,
(7) within 500 nucleotides downstream of the LCA10 target position,
(8) within 300 nucleotides downstream of the LCA10 target position,
(9) within 100 nucleotides downstream of the LCA10 target position,
(10) within 60 nucleotides downstream of the LCA10 target position, or
(11) within 40 (e.g., 1, 2, 3, 4, 5, 10, 15, 20, 25, 30, 35 or 40 nucleotides) nucleotides downstream of the LCA10 target position.

While not wishing to be bound by theory, it is believed that the two sets of breaks (e.g., the two pairs of single strand breaks) allow for break-induced deletion of genomic sequence including the mutation at the LCA10 target position in the CEP290 gene.

Methods of Treating or Preventing LCA10

Described herein are methods for treating or delaying the onset or progression of Leber's Congenital Amaurosis 10 (LCA10) caused by a c.2991+1655 A to G (adenine to guanine) mutation in the CEP290 gene. The disclosed methods for treating or delaying the onset or progression of LCA10 alter the CEP290 gene by genome editing using a gRNA targeting the LCA10 target position and a Cas9 enzyme. Details on gRNAs targeting the LCA10 target position and Cas9 enzymes are provided below.

In an embodiment, treatment is initiated prior to onset of the disease.

In an embodiment, treatment is initiated after onset of the disease.

In an embodiment, treatment is initiated prior to loss of visual acuity and/or sensitivity to glare.

In an embodiment, treatment is initiated at onset of loss of visual acuity.

In an embodiment, treatment is initiated after onset of loss of visual acuity and/or sensitivity to glare.

In an embodiment, treatment is initiated in utero.

In an embodiment, treatment is initiated after birth.

In an embodiment, treatment is initiated prior to the age of 1.

In an embodiment, treatment is initiated prior to the age of 2.

In an embodiment, treatment is initiated prior to the age of 5.

In an embodiment, treatment is initiated prior to the age of 10.

In an embodiment, treatment is initiated prior to the age of 15.

In an embodiment, treatment is initiated prior to the age of 20.

A subject's vision can evaluated, e.g., prior to treatment, or after treatment, e.g., to monitor the progress of the treatment. In an embodiment, the subject's vision is evaluated prior to treatment, e.g., to determine the need for treatment. In an embodiment, the subject's vision is evaluated after treatment has been initiated, e.g., to access the effectiveness of the treatment. Vision can be evaluated by one or more of: evaluating changes in function relative to the contralateral eye, e.g., by utilizing retinal analytical techniques; by evaluating mean, median and distribution of change in best corrected visual acuity (BCVA); evaluation by Optical Coherence Tomography; evaluation of changes in visual field using perimetry; evaluation by full-field electroretinography (ERG); evaluation by slit lamp examination; evaluation of intraocular pressure; evaluation of autofluorescence, evaluation with fundoscopy; evaluation with fundus photography; evaluation with fluorescein angiography (FA); or evaluation of visual field sensitivity (FFST).

In an embodiment, a subject's vision may be assessed by measuring the subject's mobility, e.g., the subject's ability to maneuver in space.

In an embodiment, treatment is initiated in a subject who has tested positive for a mutation in the CEP290 gene, e.g., prior to disease onset or in the earliest stages of disease.

In an embodiment, a subject has a family member that has been diagnosed with LCA10. For example, the subject has a family member that has been diagnosed with LCA10, and the subject demonstrates a symptom or sign of the disease or has been found to have a mutation in the CEP290 gene.

In an embodiment, a cell (e.g., a retinal cell, e.g., a photoreceptor cell) from a subject suffering from or likely to develop LCA10 is treated ex vivo. In an embodiment, the cell is removed from the subject, altered as described herein, and introduced into, e.g., returned to, the subject.

In an embodiment, a cell (e.g., a retinal cell, e.g., a photoreceptor cell) altered to correct a mutation in the LCA10 target position is introduced into the subject.

In an embodiment, the cell is a retinal cell (e.g., retinal pigment epithelium cell), a photoreceptor cell, a horizontal cell, a bipolar cell, an amacrine cell, or a ganglion cell. In an embodiment, it is contemplated herein that a population of cells (e.g., a population of retinal cells, e.g., a population of photoreceptor cells) from a subject may be contacted ex vivo to alter a mutation in CEP290, e.g., a 2991+1655 A to G. In an embodiment, such cells are introduced to the subject's body to prevent or treat LCA10.

In an embodiment, the population of cells are a population of retinal cells (e.g., retinal pigment epithelium cells), photoreceptor cells, horizontal cells, bipolar cells, amacrine cells, ganglion cells, or a combination thereof.

In an embodiment, the method described herein comprises delivery of gRNA or other components described herein, e.g., a Cas9 molecule, by one or more AAV vectors, e.g., one or more AAV vectors described herein.

I. Genome Editing Systems

The term "genome editing system" refers to any system having RNA-guided DNA editing activity. Genome editing systems of the present disclosure include at least two components adapted from naturally occurring CRISPR systems: a gRNA and an RNA-guided nuclease. These two components form a complex that is capable of associating with a specific nucleic acid sequence in a cell and editing the DNA in or around that nucleic acid sequence, for example by making one or more of a single-strand break (an SSB or nick), a double-strand break (a DSB) and/or a base substitution.

Naturally occurring CRISPR systems are organized evolutionarily into two classes and five types (Makarova 2011, incorporated by reference herein), and while genome editing systems of the present disclosure may adapt components of any type or class of naturally occurring CRISPR system, the embodiments presented herein are generally adapted from Class 2, and type II or V CRISPR systems. Class 2 systems, which encompass types II and V, are characterized by relatively large, multidomain RNA-guided nuclease proteins (e.g., Cas9 or Cpf1) that form ribonucleoprotein (RNP) complexes with gRNAs. gRNAs, which are discussed in greater detail below, can include single crRNAs in the case of Cpf1 or duplexed crRNAs and tracrRNAs in the case of Cas9. RNP complexes, in turn, associate with (i.e., target) and cleave specific loci complementary to a targeting (or spacer) sequence of the crRNA. Genome editing systems according to the present disclosure similarly target and edit cellular DNA sequences. but differ significantly from CRISPR systems occurring in nature. For example, the unimolecular gRNAs described herein do not occur in nature, and both gRNAs and RNA-guided nucleases according to this disclosure can incorporate any number of non-naturally occurring modifications.

Genome editing systems can be implemented in a variety of ways, and different implementations may be suitable for any particular application. For example, a genome editing system is implemented, in certain embodiments, as a protein/RNA complex (a ribonucleoprotein, or RNP), which can be included in a pharmaceutical composition that optionally includes a pharmaceutically acceptable carrier and/or an encapsulating agent, such as a lipid or polymer micro- or nano-particle, micelle, liposome, etc. In other embodiments, a genome editing system is implemented as one or more nucleic acids encoding the RNA-guided nuclease and gRNA components described above (optionally with one or more additional components); in still other embodiments, the genome editing system is implemented as one or more vectors comprising such nucleic acids, for example a viral vector such as an AAV; and in still other embodiments, the genome editing system is implemented as a combination of any of the foregoing. Additional or modified implementations that operate according to the principles set forth herein will be apparent to the skilled artisan and are within the scope of this disclosure.

It should be noted that the genome editing systems of the present invention can be targeted to a single specific nucleotide sequence, or can be targeted to—and capable of editing in parallel—two or more specific nucleotide sequences through the use of two or more gRNAs. The use of two or more gRNAs targeted to different sites is referred to as "multiplexing" throughout this disclosure, and can be employed to target multiple, unrelated target sequences of interest, or to form multiple SSBs and/or DSBs within a single target domain and, in some cases, to generate specific edits within such target domain. For example, this disclosure and International Patent Publication No. WO2015/138510 by Maeder et al. ("Maeder"), which is incorporated by reference herein, both describe a genome editing system for correcting a point mutation (C.2991+1655A to G) in the human CEP290 gene that results in the creation of a cryptic splice site, which in turn reduces or eliminates the function of the gene. The genome editing system of Maeder utilizes two gRNAs targeted to sequences on either side of (i.e., flanking) the point mutation, and forms DSBs that flank the mutation. This, in turn, promotes deletion of the intervening sequence, including the mutation, thereby eliminating the cryptic splice site and restoring normal gene function.

As another example, International Patent Publication No. WO2016/073990 by Cotta-Ramusino et al. ("Cotta-Ramusino"), incorporated by reference herein, describes a genome editing system that utilizes two gRNAs in combination with a Cas9 nickase (a Cas9 that makes a single strand nick such as *S. pyogenes* D10A), an arrangement termed a "dual-nickase system." The dual-nickase system of Cotta-Ramusino is configured to make two nicks on opposite strands of a sequence of interest that are offset by one or more nucleotides, which nicks combine to create a double strand break having an overhang (5' in the case of Cotta-Ramusino, though 3' overhangs are also possible). The overhang, in turn, can facilitate homology directed repair events in some circumstances. As another example, International Patent Publication No. WO2015/070083 by Zhang et al., incorporated by reference herein, describes a gRNA targeted to a nucleotide sequence encoding Cas9 (referred to as a "governing" gRNA), which can be included in a genome editing system comprising one or more additional gRNAs to permit transient expression of a Cas9 that might otherwise be constitutively expressed, for example in some virally transduced cells. These multiplexing applications are intended to be exemplary, rather than limiting, and the skilled artisan will appreciate that other applications of multiplexing are generally compatible with the genome editing systems described here.

Genome editing systems can, in some instances, form double strand breaks that are repaired by cellular DNA double-strand break mechanisms such as non-homologous end joining (NHEJ), or homology directed repair (HDR). These mechanisms are described throughout the literature (see, e.g., Davis 2014 (describing Alt-HDR), Frit 2014 (describing Alt-NHEJ), and Iyama 2013 (describing canonical HDR and NHEJ pathways generally), all of which are incorporated by reference herein).

Where genome editing systems operate by forming DSBs, such systems optionally include one or more components that promote or facilitate a particular mode of double-strand break repair or a particular repair outcome. For example, Cotta-Ramusino also describes genome editing systems in which a single stranded oligonucleotide "donor template" is added; the donor template is incorporated into a target region of cellular DNA that is cleaved by the genome editing system, and can result in a change in the target sequence.

In other cases, genome editing systems modify a target sequence, or modify expression of a gene in or near the target sequence, without causing single- or double-strand breaks. For example, a genome editing system can include an RNA-guided nuclease/cytidine deaminase fusion protein, and can operate by generating targeted C-to-A substitutions. Suitable nuclease/deaminase fusions are described in Komor 2016, which is incorporated by reference. Alternatively, a genome editing system can utilize a cleavage-inactivated (i.e., a "dead") nuclease, such as a dead Cas9, and can operate by forming stable complexes on one or more targeted regions of cellular DNA, thereby interfering with functions involving the targeted region(s) such as mRNA transcription and chromatin remodeling.

II. gRNA Molecules

The terms guide RNA and gRNA refer to any nucleic acid that promotes the specific association (or "targeting") of an RNA-guided nuclease such as a Cas9 or a Cpf1 to a target sequence such as a genomic or episomal sequence in a cell. gRNAs can be unimolecular (comprising a single RNA molecule, and referred to alternatively as chimeric), or modular (comprising more than one, and typically two, separate RNA molecules, such as a crRNA and a tracrRNA, which are usually associated with one another, for example by duplexing). gRNAs and their component parts are described throughout the literature (see, e.g., Briner 2014, which is incorporated by reference; see also Cotta-Ramusino).

In bacteria and archea, type II CRISPR systems generally comprise an RNA-guided nuclease protein such as Cas9, a CRISPR RNA (crRNA) that includes a 5' region that is complementary to a foreign sequence, and a trans-activating crRNA (tracrRNA) that includes a 5' region that is complementary to, and forms a duplex with, a 3' region of the crRNA. While not intending to be bound by any theory, it is thought that this duplex facilitates the formation of—and is necessary for the activity of—the Cas9/gRNA complex. As type II CRISPR systems were adapted for use in gene editing, it was discovered that the crRNA and tracrRNA could be joined into a single unimolecular or chimeric gRNA, for example by means of a four nucleotide (e.g., GAAA) "tetraloop" or "linker" sequence bridging complementary regions of the crRNA (at its 3' end) and the tracrRNA (at its 5' end) (Mali 2013; Jiang 2013; Jinek 2012; all incorporated by reference herein).

gRNAs, whether unimolecular or modular, include a targeting domain that is fully or partially complementary to a target domain within a target sequence, such as a DNA sequence in the genome of a cell where editing is desired. In certain embodiments, this target sequence encompasses or is proximal to a CEP290 target position. Targeting domains are referred to by various names in the literature, including without limitation "guide sequences" (Hsu 2013, incorporated by reference herein), "complementarity regions" (Cotta-Ramusino), "spacers" (Briner 2014), and generically as "crRNAs" (Jiang 2013). Irrespective of the names they are given, targeting domains are typically 10-30 nucleotides in length, preferably 16-24 nucleotides in length (for example, 16, 17, 18, 19, 20, 21, 22, 23 or 24 nucleotides in length), and are at or near the 5' terminus of in the case of a Cas9 gRNA, and at or near the 3' terminus in the case of a Cpf1 gRNA.

In addition to the targeting domains, gRNAs typically (but not necessarily, as discussed below) include a plurality of domains that influence the formation or activity of gRNA/Cas9 complexes. For example, as mentioned above, the duplexed structure formed by first and secondary complementarity domains of a gRNA (also referred to as a repeat: anti-repeat duplex) interacts with the recognition (REC) lobe of Cas9 and may mediate the formation of Cas9/gRNA complexes (Nishimasu 2014; Nishimasu 2015; both incorporated by reference herein). It should be noted that the first and/or second complementarity domains can contain one or more poly-A tracts, which can be recognized by RNA polymerases as a termination signal. The sequence of the first and second complementarity domains are, therefore, optionally modified to eliminate these tracts and promote the complete in vitro transcription of gRNAs, for example through the use of A-G swaps as described in Briner 2014, or A-U swaps. These and other similar modifications to the first and second complementarity domains are within the scope of the present disclosure.

Along with the first and second complementarity domains, Cas9 gRNAs typically include two or more additional duplexed regions that are necessary for nuclease activity in vivo but not necessarily in vitro (Nishimasu 2015). A first stem-loop near the 3' portion of the second complementarity domain is referred to variously as the "proximal domain" (Cotta-Ramusino) "stem loop 1" (Nishimasu 2014; Nishimasu 2015) and the "nexus" (Briner 2014). One or more additional stem loop structures are generally present near the 3' end of the gRNA, with the number varying by species: *S. pyogenes* gRNAs typically include two 3' stem loops (for a total of four stem loop structures including the repeat:anti-repeat duplex), while *S. aureus* and other species have only one (for a total of three). A description of conserved stem loop structures (and gRNA structures more generally) organized by species is provided in Briner 2014.

Skilled artisans will appreciate that gRNAs can be modified in a number of ways, some of which are described below, and these modifications are within the scope of disclosure. For economy of presentation in this disclosure, gRNAs may be presented by reference solely to their targeting domain sequences.

A gRNA molecule comprises a number of domains. The gRNA molecule domains are described in more detail below.

Several exemplary gRNA structures, with domains indicated thereon, are provided in FIG. 1. While not wishing to be bound by theory, with regard to the three dimensional form, or intra- or inter-strand interactions of an active form of a gRNA, regions of high complementarity are sometimes shown as duplexes in FIG. 1 and other depictions provided herein.

In an embodiment, a unimolecular, or chimeric, gRNA comprises, preferably from 5' to 3':
 a targeting domain (which is complementary to a target nucleic acid in the CEP290 gene, e.g., a targeting domain from any of Tables 2A-2D, Tables 3A-3C, Tables 4A-4D, Tables 5A-5D, Tables 6A-6B, Tables 7A-7D, Tables 8A-8D, Tables 9A-9E, Tables 10A-10B, or Table 11);
 a first complementarity domain;
 a linking domain;
 a second complementarity domain (which is complementary to the first complementarity domain);
 a proximal domain; and
 optionally, a tail domain.

In an embodiment, a modular gRNA comprises:
 a first strand comprising, preferably from 5' to 3';
  a targeting domain (which is complementary to a target nucleic acid in the CEP290 gene, e.g., a targeting domain from Tables 2A-2D, Tables 3A-3C, Tables 4A-4D, Tables 5A-5D, Tables 6A-6B, Tables 7A-7D, Tables 8A-8D, Tables 9A-9E, Tables 10A-10B, or Table 11); and
  a first complementarity domain; and
 a second strand, comprising, preferably from 5' to 3':
  optionally, a 5' extension domain;
  a second complementarity domain;
  a proximal domain; and
  optionally, a tail domain.

The domains are discussed briefly below.

Targeting Domain

FIGS. 1A-1G provide examples of the placement of targeting domains.

The targeting domain comprises a nucleotide sequence that is complementary, e.g., at least 80, 85, 90, or 95% complementary, e.g., fully complementary, to the target sequence on the target nucleic acid. The targeting domain is part of an RNA molecule and will therefore comprise the base uracil (U), while any DNA encoding the gRNA molecule will comprise the base thymine (T). While not wishing to be bound by theory, in an embodiment, it is believed that the complementarity of the targeting domain with the target sequence contributes to specificity of the interaction of the gRNA molecule/Cas9 molecule complex with a target nucleic acid. It is understood that in a targeting domain and target sequence pair, the uracil bases in the targeting domain will pair with the adenine bases in the target sequence. In an embodiment, the target domain itself comprises in the 5' to 3' direction, an optional secondary domain, and a core domain. In an embodiment, the core domain is fully complementary with the target sequence. In an embodiment, the targeting domain is 5 to 50 nucleotides in length. The strand of the target nucleic acid with which the targeting domain is complementary is referred to herein as the complementary strand. Some or all of the nucleotides of the domain can have a modification, e.g., a modification found in Section VIII herein.

In an embodiment, the targeting domain is 16 nucleotides in length.

In an embodiment, the targeting domain is 17 nucleotides in length.

In an embodiment, the targeting domain is 18 nucleotides in length.

In an embodiment, the targeting domain is 19 nucleotides in length.

In an embodiment, the targeting domain is 20 nucleotides in length.

In an embodiment, the targeting domain is 21 nucleotides in length.

In an embodiment, the targeting domain is 22 nucleotides in length.

In an embodiment, the targeting domain is 23 nucleotides in length.

In an embodiment, the targeting domain is 24 nucleotides in length.

In an embodiment, the targeting domain is 25 nucleotides in length.

In an embodiment, the targeting domain is 26 nucleotides in length.

In an embodiment, the targeting domain comprises 16 nucleotides.

In an embodiment, the targeting domain comprises 17 nucleotides.

In an embodiment, the targeting domain comprises 18 nucleotides.

In an embodiment, the targeting domain comprises 19 nucleotides.

In an embodiment, the targeting domain comprises 20 nucleotides.

In an embodiment, the targeting domain comprises 21 nucleotides.

In an embodiment, the targeting domain comprises 22 nucleotides.

In an embodiment, the targeting domain comprises 23 nucleotides.

In an embodiment, the targeting domain comprises 24 nucleotides.

In an embodiment, the targeting domain comprises 25 nucleotides.

In an embodiment, the targeting domain comprises 26 nucleotides.

Targeting domains are discussed in more detail below.

First Complementarity Domain

FIGS. 1A-1G provide examples of first complementarity domains.

The first complementarity domain is complementary with the second complementarity domain, and in an embodiment, has sufficient complementarity to the second complementarity domain to form a duplexed region under at least some physiological conditions. In an embodiment, the first complementarity domain is 5 to 30 nucleotides in length. In an embodiment, the first complementarity domain is 5 to 25 nucleotides in length. In an embodiment, the first complementary domain is 7 to 25 nucleotides in length. In an embodiment, the first complementary domain is 7 to 22 nucleotides in length. In an embodiment, the first complementary domain is 7 to 18 nucleotides in length. In an embodiment, the first complementary domain is 7 to 15 nucleotides in length. In an embodiment, the first complementary domain is 5, 6, 7, 8, 9, 10, 11, 12, 13, 14, 15, 16, 17, 18, 19, 20, 21, 22, 23, 24, or 25 nucleotides in length.

In an embodiment, the first complementarity domain comprises 3 subdomains, which, in the 5' to 3' direction are: a 5' subdomain, a central subdomain, and a 3' subdomain. In an embodiment, the 5' subdomain is 4-9, e.g., 4, 5, 6, 7, 8 or 9 nucleotides in length. In an embodiment, the central subdomain is 1, 2, or 3, e.g., 1, nucleotide in length. In an embodiment, the 3' subdomain is 3 to 25, e.g., 4-22, 4-18, or 4 to 10, or 3, 4, 5, 6, 7, 8, 9, 10, 11, 12, 13, 14, 15, 16, 17, 18, 19, 20, 21, 22, 23, 24, or 25, nucleotides in length.

The first complementarity domain can share homology with, or be derived from, a naturally occurring first complementarity domain. In an embodiment, it has at least 50% homology with a first complementarity domain disclosed herein, e.g., an *S. pyogenes, S. aureus*, or *S. thermophilus*, first complementarity domain.

Some or all of the nucleotides of the domain can have a modification, e.g., a modification found in Section VIII herein.

First complementarity domains are discussed in more detail below.

Linking Domain

FIGS. 1A-1G provide examples of linking domains.

A linking domain serves to link the first complementarity domain with the second complementarity domain of a unimolecular gRNA. The linking domain can link the first and second complementarity domains covalently or non-covalently. In an embodiment, the linkage is covalent. In an embodiment, the linking domain covalently couples the first and second complementarity domains, see, e.g., FIGS. 1B-1E. In an embodiment, the linking domain is, or comprises, a covalent bond interposed between the first complementarity domain and the second complementarity domain. Typically the linking domain comprises one or more, e.g., 2, 3, 4, 5, 6, 7, 8, 9, or 10 nucleotides.

In modular gRNA molecules the two molecules are associated by virtue of the hybridization of the complementarity domains see e.g., FIG. 1A.

A wide variety of linking domains are suitable for use in unimolecular gRNA molecules. Linking domains can consist of a covalent bond, or be as short as one or a few nucleotides, e.g., 1, 2, 3, 4, or 5 nucleotides in length. In an embodiment, a linking domain is 2, 3, 4, 5, 6, 7, 8, 9, 10, 15, 20, or 25 or more nucleotides in length. In an embodiment, a linking domain is 2 to 50, 2 to 40, 2 to 30, 2 to 20, 2 to 10, or 2 to 5 nucleotides in length. In an embodiment, a linking domain shares homology with, or is derived from, a naturally occurring sequence, e.g., the sequence of a tracrRNA that is 5' to the second complementarity domain. In an embodiment, the linking domain has at least 50% homology with a linking domain disclosed herein.

Some or all of the nucleotides of the domain can have a modification, e.g., a modification found in Section VIII herein.

Linking domains are discussed in more detail below.

5' Extension Domain

In an embodiment, a modular gRNA can comprise additional sequence, 5' to the second complementarity domain, referred to herein as the 5' extension domain, see, e.g., FIG. 1A. In an embodiment, the 5' extension domain is, 2-10, 2-9, 2-8, 2-7, 2-6, 2-5, or 2-4 nucleotides in length. In an embodiment, the 5' extension domain is 2, 3, 4, 5, 6, 7, 8, 9, or 10 or more nucleotides in length.

Second Complementarity Domain

FIGS. 1A-1G provide examples of second complementarity domains.

Figure 1B:
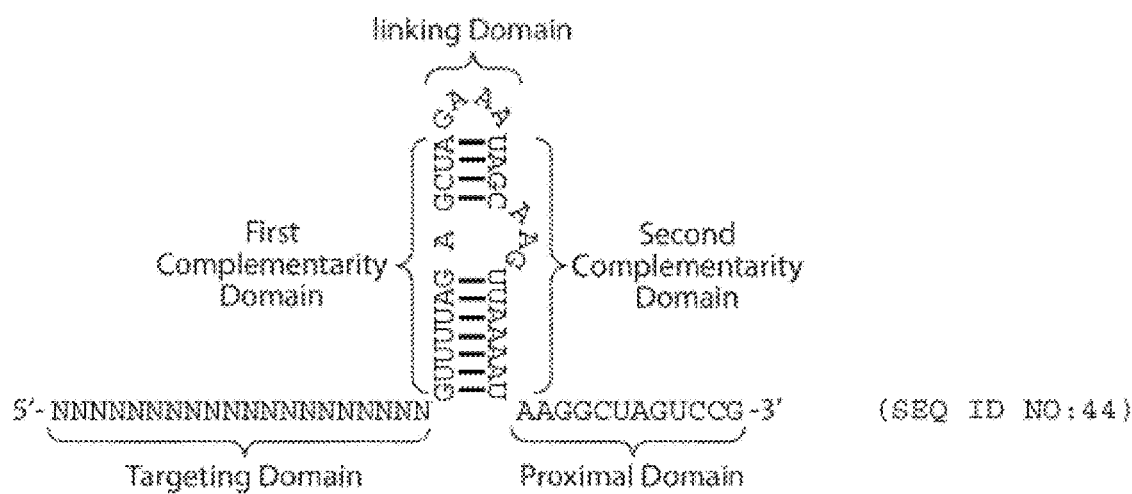
Figure 1C:
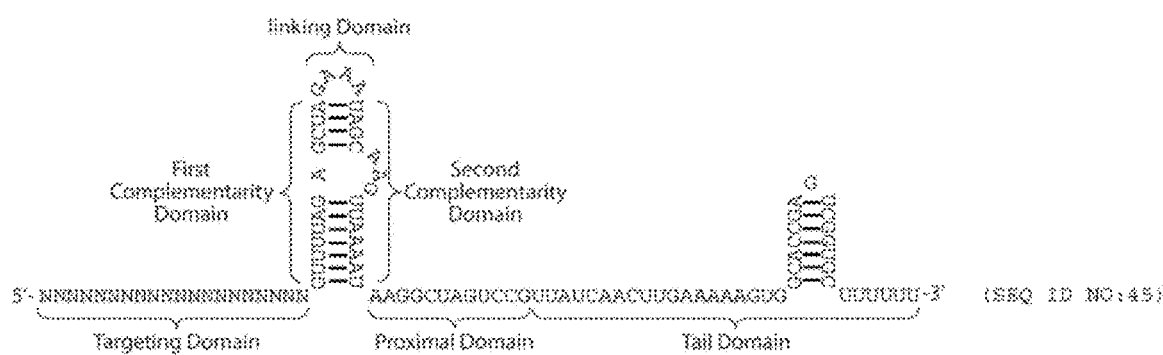
Figure 1D:
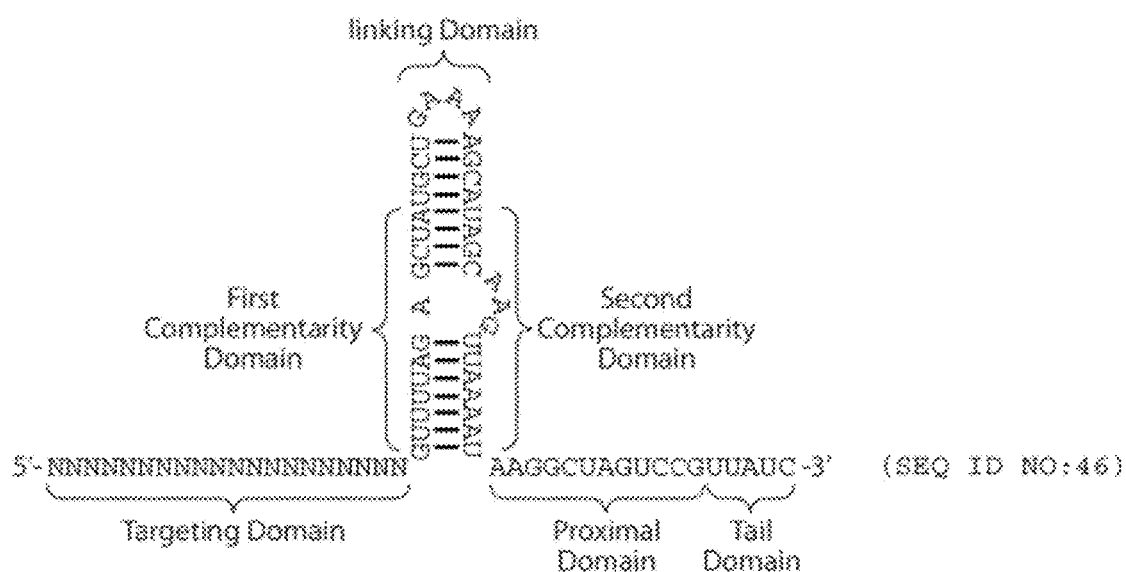
Figure 1E:
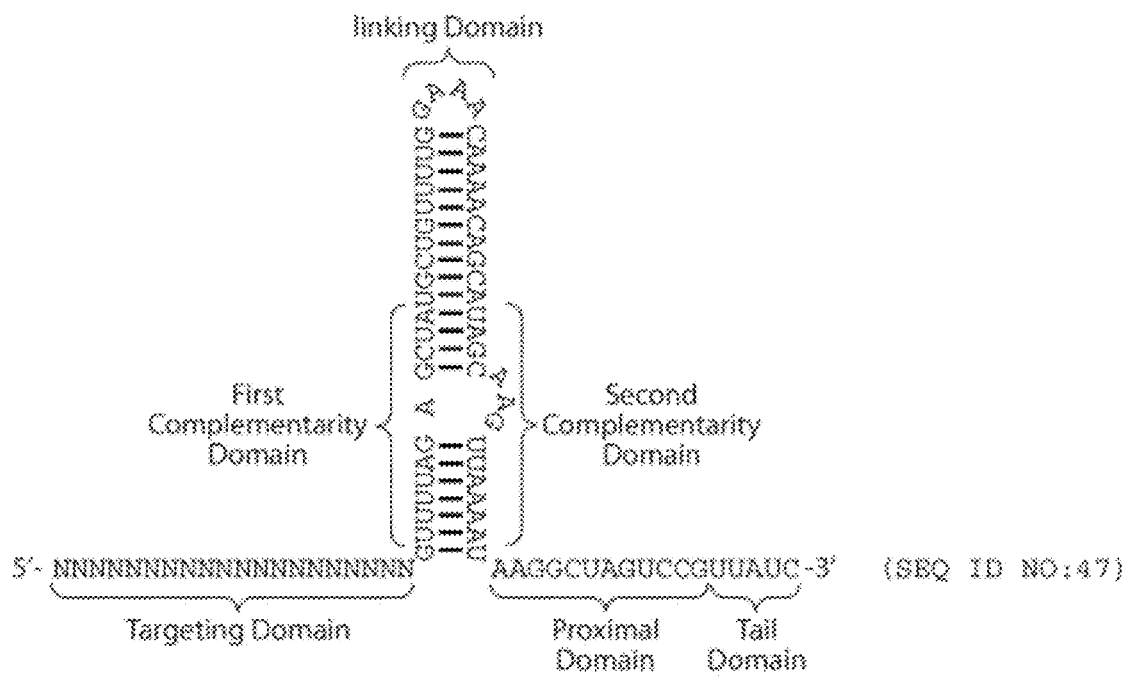
Figure 1F:
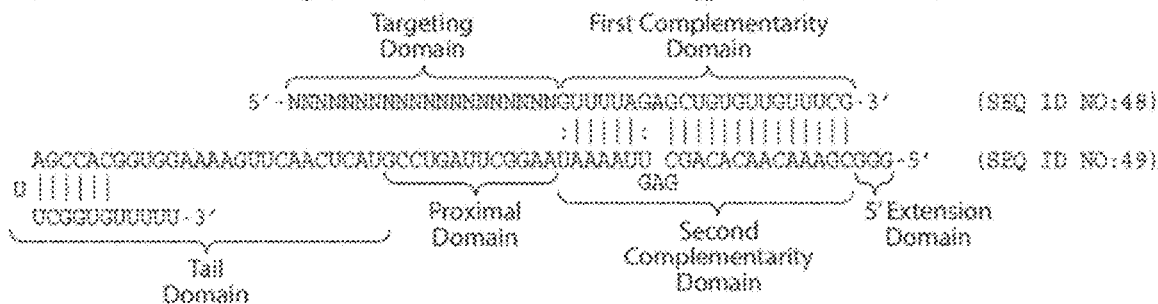
Figure 1G:
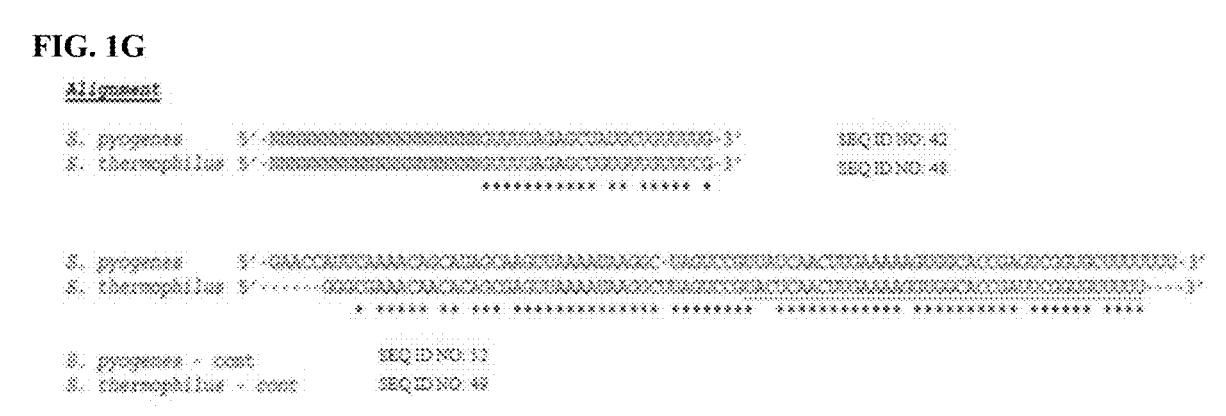

The second complementarity domain is complementary with the first complementarity domain, and in an embodiment, has sufficient complementarity to the second complementarity domain to form a duplexed region under at least some physiological conditions. In an embodiment, e.g., as shown in FIGS. 1A-1B, the second complementarity domain can include sequence that lacks complementarity with the first complementarity domain, e.g., sequence that loops out from the duplexed region.

In an embodiment, the second complementarity domain is 5 to 27 nucleotides in length. In an embodiment, it is longer than the first complementarity region. In an embodiment the second complementary domain is 7 to 27 nucleotides in length. In an embodiment, the second complementary domain is 7 to 25 nucleotides in length. In an embodiment, the second complementary domain is 7 to 20 nucleotides in length. In an embodiment, the second complementary domain is 7 to 17 nucleotides in length. In an embodiment, the complementary domain is 5, 6, 7, 8, 9, 10, 11, 12, 13, 14, 15, 16, 17, 18, 19, 20, 21, 22, 23, 24, 25 or 26 nucleotides in length.

In an embodiment, the second complementarity domain comprises 3 subdomains, which, in the 5' to 3' direction are: a 5' subdomain, a central subdomain, and a 3' subdomain. In an embodiment, the 5' subdomain is 3 to 25, e.g., 4 to 22, 4 to 18, or 4 to 10, or 3, 4, 5, 6, 7, 8, 9, 10, 11, 12, 13, 14, 15, 16, 17, 18, 19, 20, 21, 22, 23, 24, or 25 nucleotides in length. In an embodiment, the central subdomain is 1, 2, 3, 4 or 5, e.g., 3, nucleotides in length. In an embodiment, the 3' subdomain is 4 to 9, e.g., 4, 5, 6, 7, 8 or 9 nucleotides in length.

In an embodiment, the 5' subdomain and the 3' subdomain of the first complementarity domain, are respectively, complementary, e.g., fully complementary, with the 3' subdomain and the 5' subdomain of the second complementarity domain.

The second complementarity domain can share homology with or be derived from a naturally occurring second complementarity domain. In an embodiment, it has at least 50% homology with a second complementarity domain disclosed herein, e.g., an *S. pyogenes, S. aureus*, or *S. thermophilus*, first complementarity domain.

Some or all of the nucleotides of the domain can have a modification, e.g., a modification found in Section VIII herein.

Proximal Domain

FIGS. 1A-1G provide examples of proximal domains.

In an embodiment, the proximal domain is 5 to 20 nucleotides in length. In an embodiment, the proximal domain can share homology with or be derived from a naturally occurring proximal domain. In an embodiment, it has at least 50% homology with a proximal domain disclosed herein, e.g., an *S. pyogenes, S. aureus*, or *S. thermophilus*, proximal domain.

Some or all of the nucleotides of the domain can have a modification, e.g., a modification found in Section VIII herein.

Tail Domain

FIGS. 1A-1G provide examples of tail domains.

As can be seen by inspection of the tail domains in FIGS. 1A and 1B-1F, a broad spectrum of tail domains are suitable for use in gRNA molecules. In an embodiment, the tail domain is 0 (absent), 1, 2, 3, 4, 5, 6, 7, 8, 9, or 10 nucleotides in length. In embodiment, the tail domain nucleotides are from or share homology with sequence from the 5' end of a naturally occurring tail domain, see e.g., FIG. 1D or 1E. In an embodiment, the tail domain includes sequences that are complementary to each other and which, under at least some physiological conditions, form a duplexed region.

In an embodiment, the tail domain is absent or is 1 to 50 nucleotides in length. In an embodiment, the tail domain can share homology with or be derived from a naturally occurring proximal tail domain. In an embodiment, it has at least 50% homology with a tail domain disclosed herein, e.g., an *S. pyogenes, S. aureus*, or *S. thermophilus*, tail domain.

In an embodiment, the tail domain includes nucleotides at the 3' end that are related to the method of in vitro or in vivo transcription. When a T7 promoter is used for in vitro transcription of the gRNA, these nucleotides may be any nucleotides present before the 3' end of the DNA template. When a U6 promoter is used for in vivo transcription, these nucleotides may be the sequence UUUUUU. When alternate pol-III promoters are used, these nucleotides may be various numbers or uracil bases or may include alternate bases.

The domains of gRNA molecules are described in more detail below.

Targeting Domain

The "targeting domain" of the gRNA is complementary to the "target domain" on the target nucleic acid. The strand of the target nucleic acid comprising the core domain target is referred to herein as the "complementary strand" of the target nucleic acid. Guidance on the selection of targeting domains can be found, e.g., in Fu 2014 and Sternberg 2014.

In an embodiment, the targeting domain is 16, 17, 18, 19, 20, 21, 22, 23, 24, 25 or 26 nucleotides in length. In the figures and sequence listing provided herein, targeting domains are generally shown with 20 nucleotides. In each of these instances, the targeting domain may actually be shorter or longer as disclosed herein, for example from 16 to 26 nucleotides.

In an embodiment, the targeting domain is 16 nucleotides in length.

In an embodiment, the targeting domain is 17 nucleotides in length.

In an embodiment, the targeting domain is 18 nucleotides in length.

In an embodiment, the targeting domain is 19 nucleotides in length.

In an embodiment, the targeting domain is 20 nucleotides in length.

In an embodiment, the targeting domain is 21 nucleotides in length.

In an embodiment, the targeting domain is 22 nucleotides in length.

In an embodiment, the targeting domain is 23 nucleotides in length.

In an embodiment, the targeting domain is 24 nucleotides in length.

In an embodiment, the targeting domain is 25 nucleotides in length.

In an embodiment, the targeting domain is 26 nucleotides in length.

In an embodiment, the targeting domain comprises 16 nucleotides.

In an embodiment, the targeting domain comprises 17 nucleotides.

In an embodiment, the targeting domain comprises 18 nucleotides.

In an embodiment, the targeting domain comprises 19 nucleotides.

In an embodiment, the targeting domain comprises 20 nucleotides.

In an embodiment, the targeting domain comprises 21 nucleotides.

In an embodiment, the targeting domain comprises 22 nucleotides.

In an embodiment, the targeting domain comprises 23 nucleotides.

In an embodiment, the targeting domain comprises 24 nucleotides.

In an embodiment, the targeting domain comprises 25 nucleotides.

In an embodiment, the targeting domain comprises 26 nucleotides.

In an embodiment, the targeting domain is 10+/−5, 20+/−5, 30+/−5, 40+/−5, 50+/−5, 60+/−5, 70+/−5, 80+/−5, 90+/−5, or 100+/−5 nucleotides, in length.

In an embodiment, the targeting domain is 20+/−5 nucleotides in length.

In an embodiment, the targeting domain is 20+/−10, 30+/−10, 40+/−10, 50+/−10, 60+/−10, 70+/−10, 80+/−10, 90+/−10, or 100+/−10 nucleotides, in length.

In an embodiment, the targeting domain is 30+/−10 nucleotides in length.

In an embodiment, the targeting domain is 10 to 100, 10 to 90, 10 to 80, 10 to 70, 10 to 60, 10 to 50, 10 to 40, 10 to 30, 10 to 20 or 10 to 15 nucleotides in length. In other embodiments, the targeting domain is 20 to 100, 20 to 90, 20 to 80, 20 to 70, 20 to 60, 20 to 50, 20 to 40, 20 to 30, or 20 to 25 nucleotides in length.

Typically the targeting domain has full complementarity with the target sequence. In some embodiments the targeting domain has or includes 1, 2, 3, 4, 5, 6, 7 or 8 nucleotides that are not complementary with the corresponding nucleotide of the targeting domain.

In an embodiment, the target domain includes 1, 2, 3, 4 or 5 nucleotides that are complementary with the corresponding nucleotide of the targeting domain within 5 nucleotides of its 5' end. In an embodiment, the target domain includes 1, 2, 3, 4 or 5 nucleotides that are complementary with the corresponding nucleotide of the targeting domain within 5 nucleotides of its 3' end.

In an embodiment, the target domain includes 1, 2, 3, or 4 nucleotides that are not complementary with the corresponding nucleotide of the targeting domain within 5 nucleotides of its 5' end. In an embodiment, the target domain includes 1, 2, 3, or 4 nucleotides that are not complementary with the corresponding nucleotide of the targeting domain within 5 nucleotides of its 3' end.

In an embodiment, the degree of complementarity, together with other properties of the gRNA, is sufficient to allow targeting of a Cas9 molecule to the target nucleic acid.

In some embodiments, the targeting domain comprises two consecutive nucleotides that are not complementary to the target domain ("non-complementary nucleotides"), e.g., two consecutive noncomplementary nucleotides that are within 5 nucleotides of the 5' end of the targeting domain, within 5 nucleotides of the 3' end of the targeting domain, or more than 5 nucleotides away from one or both ends of the targeting domain.

In an embodiment, no two consecutive nucleotides within 5 nucleotides of the 5' end of the targeting domain, within 5 nucleotides of the 3' end of the targeting domain, or within a region that is more than 5 nucleotides away from one or both ends of the targeting domain, are not complementary to the targeting domain.

In an embodiment, there are no noncomplementary nucleotides within 5 nucleotides of the 5' end of the targeting domain, within 5 nucleotides of the 3' end of the targeting domain, or within a region that is more than 5 nucleotides away from one or both ends of the targeting domain.

In an embodiment, the targeting domain nucleotides do not comprise modifications, e.g., modifications of the type provided in Section VIII. However, in an embodiment, the targeting domain comprises one or more modifications, e.g., modifications that it render it less susceptible to degradation or more bio-compatible, e.g., less immunogenic. By way of example, the backbone of the targeting domain can be modified with a phosphorothioate, or other modification(s) from Section VIII. In an embodiment, a nucleotide of the targeting domain can comprise a 2' modification, e.g., a 2-acetylation, e.g., a 2' methylation, or other modification(s) from Section VIII.

In some embodiments, the targeting domain includes 1, 2, 3, 4, 5, 6, 7 or 8 or more modifications. In an embodiment, the targeting domain includes 1, 2, 3, or 4 modifications within 5 nucleotides of its 5' end. In an embodiment, the targeting domain comprises as many as 1, 2, 3, or 4 modifications within 5 nucleotides of its 3' end.

In some embodiments, the targeting domain comprises modifications at two consecutive nucleotides, e.g., two consecutive nucleotides that are within 5 nucleotides of the 5' end of the targeting domain, within 5 nucleotides of the 3' end of the targeting domain, or more than 5 nucleotides away from one or both ends of the targeting domain.

In an embodiment, no two consecutive nucleotides are modified within 5 nucleotides of the 5' end of the targeting domain, within 5 nucleotides of the 3' end of the targeting domain, or within a region that is more than 5 nucleotides away from one or both ends of the targeting domain. In an embodiment, no nucleotide is modified within 5 nucleotides of the 5' end of the targeting domain, within 5 nucleotides of the 3' end of the targeting domain, or within a region that is more than 5 nucleotides away from one or both ends of the targeting domain.

Modifications in the targeting domain can be selected to not interfere with targeting efficacy, which can be evaluated by testing a candidate modification in the system described in Section V. gRNAs having a candidate targeting domain having a selected length, sequence, degree of complementarity, or degree of modification, can be evaluated in a system in Section V. The candidate targeting domain can be placed, either alone, or with one or more other candidate changes in a gRNA molecule/Cas9 molecule system known to be functional with a selected target and evaluated.

In some embodiments, all of the modified nucleotides are complementary to and capable of hybridizing to corresponding nucleotides present in the target domain. In other embodiments, 1, 2, 3, 4, 5, 6, 7 or 8 or more modified nucleotides are not complementary to or capable of hybridizing to corresponding nucleotides present in the target domain.

In an embodiment, the targeting domain comprises, preferably in the 5'→3' direction: a secondary domain and a core domain. These domains are discussed in more detail below.

Core Domain and Secondary Domain of the Targeting Domain

The "core domain" of the targeting domain is complementary to the "core domain target" on the target nucleic acid. In an embodiment, the core domain comprises about 8 to about 13 nucleotides from the 3' end of the targeting domain (e.g., the most 3' 8 to 13 nucleotides of the targeting domain).

In an embodiment, the secondary domain is absent or optional.

In an embodiment, the core domain and targeting domain, are independently, 6+/−2, 7+/−2, 8+/−2, 9+/−2, 10+/−2, 11+/−2, 12+/−2, 13+/−2, 14+/−2, 15+/−2, 16+/−2, 17+/−2, or 18+/−2, nucleotides in length.

In an embodiment, the core domain and targeting domain, are independently, 10+/−2 nucleotides in length.

In an embodiment, the core domain and targeting domain, are independently, 10+/−4 nucleotides in length.

In an embodiment, the core domain and targeting domain, are independently, 6, 7, 8, 9, 10, 11, 12, 13, 14, 15, 16, 17, or 18, nucleotides in length.

In an embodiment, the core domain and targeting domain, are independently 3 to 20, 4 to 20, 5 to 20, 6 to 20, 7 to 20, 8 to 20, 9 to 20 10 to 20 or 15 to 20 nucleotides in length.

In an embodiment, the core domain and targeting domain, are independently 3 to 15, e.g., 6 to 15, 7 to 14, 7 to 13, 6 to 12, 7 to 12, 7 to 11, 7 to 10, 8 to 14, 8 to 13, 8 to 12, 8 to 11, 8 to 10 or 8 to 9 nucleotides in length.

The core domain is complementary with the core domain target. Typically the core domain has exact complementarity with the core domain target. In some embodiments, the core domain can have 1, 2, 3, 4 or 5 nucleotides that are not complementary with the corresponding nucleotide of the core domain. In an embodiment, the degree of complementarity, together with other properties of the gRNA, is sufficient to allow targeting of a Cas9 molecule to the target nucleic acid.

The "secondary domain" of the targeting domain of the gRNA is complementary to the "secondary domain target" of the target nucleic acid.

In an embodiment, the secondary domain is positioned 5' to the core domain.

In an embodiment, the secondary domain is absent or optional.

In an embodiment, if the targeting domain is 26 nucleotides in length and the core domain (counted from the 3' end of the targeting domain) is 8 to 13 nucleotides in length, the secondary domain is 12 to 17 nucleotides in length.

In an embodiment, if the targeting domain is 25 nucleotides in length and the core domain (counted from the 3' end of the targeting domain) is 8 to 13 nucleotides in length, the secondary domain is 12 to 17 nucleotides in length.

In an embodiment, if the targeting domain is 24 nucleotides in length and the core domain (counted from the 3' end of the targeting domain) is 8 to 13 nucleotides in length, the secondary domain is 11 to 16 nucleotides in length.

In an embodiment, if the targeting domain is 23 nucleotides in length and the core domain (counted from the 3' end of the targeting domain) is 8 to 13 nucleotides in length, the secondary domain is 10 to 15 nucleotides in length.

In an embodiment, if the targeting domain is 22 nucleotides in length and the core domain (counted from the 3' end of the targeting domain) is 8 to 13 nucleotides in length, the secondary domain is 9 to 14 nucleotides in length.

In an embodiment, if the targeting domain is 21 nucleotides in length and the core domain (counted from the 3' end of the targeting domain) is 8 to 13 nucleotides in length, the secondary domain is 8 to 13 nucleotides in length.

In an embodiment, if the targeting domain is 20 nucleotides in length and the core domain (counted from the 3' end of the targeting domain) is 8 to 13 nucleotides in length, the secondary domain is 7 to 12 nucleotides in length.

In an embodiment, if the targeting domain is 19 nucleotides in length and the core domain (counted from the 3' end of the targeting domain) is 8 to 13 nucleotides in length, the secondary domain is 6 to 11 nucleotides in length.

In an embodiment, if the targeting domain is 18 nucleotides in length and the core domain (counted from the 3' end of the targeting domain) is 8 to 13 nucleotides in length, the secondary domain is 5 to 10 nucleotides in length.

In an embodiment, if the targeting domain is 17 nucleotides in length and the core domain (counted from the 3' end of the targeting domain) is 8 to 13 nucleotides in length, the secondary domain is 4 to 9 nucleotides in length.

In an embodiment, if the targeting domain is 16 nucleotides in length and the core domain (counted from the 3' end of the targeting domain) is 8 to 13 nucleotides in length, the secondary domain is 3 to 8 nucleotides in length.

In an embodiment, the secondary domain is 0, 1, 2, 3, 4, 5, 6, 7, 8, 9, 10, 11, 12, 13, 14 or 15 nucleotides in length.

The secondary domain is complementary with the secondary domain target. Typically the secondary domain has exact complementarity with the secondary domain target. In some embodiments the secondary domain can have 1, 2, 3, 4 or 5 nucleotides that are not complementary with the corresponding nucleotide of the secondary domain. In an embodiment, the degree of complementarity, together with other properties of the gRNA, is sufficient to allow targeting of a Cas9 molecule to the target nucleic acid.

In an embodiment, the core domain nucleotides do not comprise modifications, e.g., modifications of the type provided in Section VIII. However, in an embodiment, the core domain comprise one or more modifications, e.g., modifications that it render it less susceptible to degradation or more bio-compatible, e.g., less immunogenic. By way of example, the backbone of the core domain can be modified with a phosphorothioate, or other modification(s) from Section VIII. In an embodiment a nucleotide of the core domain can comprise a 2' modification, e.g., a 2-acetylation, e.g., a 2' methylation, or other modification(s) from Section VIII. Typically, a core domain will contain no more than 1, 2, or 3 modifications.

Modifications in the core domain can be selected to not interfere with targeting efficacy, which can be evaluated by testing a candidate modification in the system described in Section V. gRNA's having a candidate core domain having a selected length, sequence, degree of complementarity, or degree of modification, can be evaluated in the system described at Section V. The candidate core domain can be placed, either alone, or with one or more other candidate changes in a gRNA molecule/Cas9 molecule system known to be functional with a selected target and evaluated.

In an embodiment, the secondary domain nucleotides do not comprise modifications, e.g., modifications of the type provided in Section VIII. However, in an embodiment, the secondary domain comprises one or more modifications, e.g., modifications that it render it less susceptible to degradation or more bio-compatible, e.g., less immunogenic. By way of example, the backbone of the secondary domain can be modified with a phosphorothioate, or other modification(s) from Section VIII. In an embodiment a nucleotide of the secondary domain can comprise a 2' modification, e.g., a 2-acetylation, e.g., a 2' methylation, or other modification(s) from Section VIII. Typically, a secondary domain will contain no more than 1, 2, or 3 modifications.

Modifications in the secondary domain can be selected to not interfere with targeting efficacy, which can be evaluated by testing a candidate modification in the system described in Section V. gRNA's having a candidate secondary domain having a selected length, sequence, degree of complementarity, or degree of modification, can be evaluated in the system described at Section V. The candidate secondary domain can be placed, either alone, or with one or more other candidate changes in a gRNA molecule/Cas9 molecule system known to be functional with a selected target and evaluated.

In an embodiment, (1) the degree of complementarity between the core domain and its target, and (2) the degree of complementarity between the secondary domain and its target, may differ. In an embodiment, (1) may be greater (2). In an embodiment, (1) may be less than (2). In an embodiment, (1) and (2) are the same, e.g., each may be completely complementary with its target.

In an embodiment, (1) the number of modification (e.g., modifications from Section VIII) of the nucleotides of the core domain and (2) the number of modification (e.g., modifications from Section VIII) of the nucleotides of the secondary domain, may differ. In an embodiment, (1) may be less than (2). In an embodiment, (1) may be greater than (2). In an embodiment, (1) and (2) may be the same, e.g., each may be free of modifications.

First and Second Complementarity Domains

The first complementarity domain is complementary with the second complementarity domain.

Typically the first domain does not have exact complementarity with the second complementarity domain target. In some embodiments, the first complementarity domain can have 1, 2, 3, 4 or 5 nucleotides that are not complementary with the corresponding nucleotide of the second complementarity domain. In an embodiment, 1, 2, 3, 4, 5 or 6, e.g., 3 nucleotides, will not pair in the duplex, and, e.g., form a non-duplexed or looped-out region. In an embodiment, an unpaired, or loop-out, region, e.g., a loop-out of 3 nucleotides, is present on the second complementarity domain. In an embodiment, the unpaired region begins 1, 2, 3, 4, 5, or 6, e.g., 4, nucleotides from the 5' end of the second complementarity domain.

In an embodiment, the degree of complementarity, together with other properties of the gRNA, is sufficient to allow targeting of a Cas9 molecule to the target nucleic acid.

In an embodiment, the first and second complementarity domains are:

independently, 6+/−2, 7+/−2, 8+/−2, 9+/−2, 10+/−2, 11+/−2, 12+/−2, 13+/−2, 14+/−2, 15+/−2, 16+/−2, 17+/−2, 18+/−2, 19+/−2, or 20+/−2, 21+/−2, 22+/−2, 23+/−2, or 24+/−2 nucleotides in length;

independently, 6, 7, 8, 9, 10, 11, 12, 13, 14, 14, 16, 17, 18, 19, 20, 21, 22, 23, 24, 25, or 26, nucleotides in length; or independently, 5 to 24, 5 to 23, 5 to 22, 5 to 21, 5 to 20, 7 to 18, 9 to 16, or 10 to 14 nucleotides in length.

In an embodiment, the second complementarity domain is longer than the first complementarity domain, e.g., 2, 3, 4, 5, or 6, e.g., 6, nucleotides longer.

In an embodiment, the first and second complementary domains, independently, do not comprise modifications, e.g., modifications of the type provided in Section VIII.

In an embodiment, the first and second complementary domains, independently, comprise one or more modifications, e.g., modifications that the render the domain less susceptible to degradation or more bio-compatible, e.g., less immunogenic. By way of example, the backbone of the domain can be modified with a phosphorothioate, or other modification(s) from Section VIII. In an embodiment a nucleotide of the domain can comprise a 2' modification, e.g., a 2-acetylation, e.g., a 2' methylation, or other modification(s) from Section VIII.

In an embodiment, the first and second complementary domains, independently, include 1, 2, 3, 4, 5, 6, 7 or 8 or more modifications. In an embodiment, the first and second complementary domains, independently, include 1, 2, 3, or 4 modifications within 5 nucleotides of its 5' end. In an embodiment, the first and second complementary domains, independently, include as many as 1, 2, 3, or 4 modifications within 5 nucleotides of its 3' end.

In an embodiment, the first and second complementary domains, independently, include modifications at two consecutive nucleotides, e.g., two consecutive nucleotides that are within 5 nucleotides of the 5' end of the domain, within 5 nucleotides of the 3' end of the domain, or more than 5 nucleotides away from one or both ends of the domain. In an embodiment, the first and second complementary domains, independently, include no two consecutive nucleotides that are modified, within 5 nucleotides of the 5' end of the domain, within 5 nucleotides of the 3' end of the domain, or within a region that is more than 5 nucleotides away from one or both ends of the domain. In an embodiment, the first and second complementary domains, independently, include no nucleotide that is modified within 5 nucleotides of the 5' end of the domain, within 5 nucleotides of the 3' end of the domain, or within a region that is more than 5 nucleotides away from one or both ends of the domain.

Modifications in a complementarity domain can be selected to not interfere with targeting efficacy, which can be evaluated by testing a candidate modification in the system described in Section V. gRNA's having a candidate complementarity domain having a selected length, sequence, degree of complementarity, or degree of modification, can be evaluated in the system described in Section V. The candidate complementarity domain can be placed, either alone, or with one or more other candidate changes in a gRNA molecule/Cas9 molecule system known to be functional with a selected target and evaluated.

In an embodiment, the first complementarity domain has at least 60, 70, 80, 85%, 90% or 95% homology with, or differs by no more than 1, 2, 3, 4, 5, or 6 nucleotides from, a reference first complementarity domain, e.g., a naturally occurring, e.g., an S. pyogenes, S. aureus, or S. thermophilus, first complementarity domain, or a first complementarity domain described herein, e.g., from FIGS. 1A-1G.

In an embodiment, the second complementarity domain has at least 60, 70, 80, 85%, 90%, or 95% homology with, or differs by no more than 1, 2, 3, 4, 5, or 6 nucleotides from, a reference second complementarity domain, e.g., a naturally occurring, e.g., an S. pyogenes, S. aureus, or S. thermophilus, second complementarity domain, or a second complementarity domain described herein, e.g., from FIG. 1A-1G.

The duplexed region formed by first and second complementarity domains is typically 6, 7, 8, 9, 10, 11, 12, 13, 14, 15, 16, 17, 18, 19, 20, 21 or 22 base pairs in length (excluding any looped out or unpaired nucleotides).

In some embodiments, the first and second complementarity domains, when duplexed, comprise 11 paired nucleotides, for example in the gRNA sequence (one paired strand underlined, one bolded):

(SEQ ID NO: 5)
NNNNNNNNNNNNNNNNNNNNNGUUUUAGAGCUAGAAAUAGCAAGUUAAAAU

AAGGCUAGUCCGUUAUCAACUUGAAAAAGUGGCACCGAGUCGGUGC.

In some embodiments, the first and second complementarity domains, when duplexed, comprise 15 paired nucleotides, for example in the gRNA sequence (one paired strand underlined, one bolded):

(SEQ ID NO: 27)
NNNNNNNNNNNNNNNNNNNNNGUUUUAGAGCUAUGCUGAAAAGCAUAGCAA

GUUAAAAUAAGGCUAGUCCGUUAUCAACUUGAAAAAGUGGCACCGAGUCG

GUGC.

In some embodiments the first and second complementarity domains, when duplexed, comprise 16 paired nucleotides, for example in the gRNA sequence (one paired strand underlined, one bolded):

(SEQ ID NO: 28)
NNNNNNNNNNNNNNNNNNNNNGUUUUAGAGCUAUGCUGGAAACAGCAUAGC

AAGUUAAAAUAAGGCUAGUCCGUUAUCAACUUGAAAAAGUGGCACCGAGU

CGGUGC.

In some embodiments the first and second complementarity domains, when duplexed, comprise 21 paired nucleotides, for example in the gRNA sequence (one paired strand underlined, one bolded):

(SEQ ID NO: 29)
NNNNNNNNNNNNNNNNNNNNNGUUUUAGAGCUAUGCUGUUUUGGAAACAAA

ACAGCAUAGCAAGUUAAAAUAAGGCUAGUCCGUUAUCAACUUGAAAAAGU

GGCACCGAGUCGGUGC.

In some embodiments, nucleotides are exchanged to remove poly-U tracts, for example in the gRNA sequences (exchanged nucleotides underlined):

(SEQ ID NO: 30)
NNNNNNNNNNNNNNNNNNNNNGUAUUAGAGCUAGAAAUAGCAAGUUAAUAU

AAGGCUAGUCCGUUAUCAACUUGAAAAAGUGGCACCGAGUCGGUGC;

(SEQ ID NO: 31)
NNNNNNNNNNNNNNNNNNNNNGUUUAAGAGCUAGAAAUAGCAAGUUUAAAU

AAGGCUAGUCCGUUAUCAACUUGAAAAAGUGGCACCGAGUCGGUGC;
and (SEQ ID NO: 32)
NNNNNNNNNNNNNNNNNNNNNGUAUUAGAGCUAUGCUGUAUUGGAAACAAU

ACAGCAUAGCAAGUUAAUAUAAGGCUAGUCCGUUAUCAACUUGAAAAAGU

GGCACCGAGUCGGUGC.

5' Extension Domain

In an embodiment, a modular gRNA can comprise additional sequence, 5' to the second complementarity domain. In an embodiment, the 5' extension domain is 2 to 10, 2 to 9, 2 to 8, 2 to 7, 2 to 6, 2 to 5, or 2 to 4 nucleotides in length. In an embodiment, the 5' extension domain is 2, 3, 4, 5, 6, 7, 8, 9, or 10 or more nucleotides in length.

In an embodiment, the 5' extension domain nucleotides do not comprise modifications, e.g., modifications of the type provided in Section VIII. However, in an embodiment, the 5' extension domain comprises one or more modifications, e.g., modifications that it render it less susceptible to degradation or more bio-compatible, e.g., less immunogenic. By way of example, the backbone of the 5' extension domain can be modified with a phosphorothioate, or other modification(s) from Section VIII. In an embodiment, a nucleotide of the 5' extension domain can comprise a 2' modification, e.g., a 2-acetylation, e.g., a 2' methylation, or other modification(s) from Section VIII.

In some embodiments, the 5' extension domain can comprise as many as 1, 2, 3, 4, 5, 6, 7 or 8 modifications. In an embodiment, the 5' extension domain comprises as many as 1, 2, 3, or 4 modifications within 5 nucleotides of its 5' end, e.g., in a modular gRNA molecule. In an embodiment, the 5' extension domain comprises as many as 1, 2, 3, or 4 modifications within 5 nucleotides of its 3' end, e.g., in a modular gRNA molecule.

In some embodiments, the 5' extension domain comprises modifications at two consecutive nucleotides, e.g., two consecutive nucleotides that are within 5 nucleotides of the 5' end of the 5' extension domain, within 5 nucleotides of the 3' end of the 5' extension domain, or more than 5 nucleotides away from one or both ends of the 5' extension domain. In an embodiment, no two consecutive nucleotides are modified within 5 nucleotides of the 5' end of the 5' extension domain, within 5 nucleotides of the 3' end of the 5' extension domain, or within a region that is more than 5 nucleotides away from one or both ends of the 5' extension domain. In an embodiment, no nucleotide is modified within 5 nucleotides of the 5' end of the 5' extension domain, within 5 nucleotides of the 3' end of the 5' extension domain, or within a region that is more than 5 nucleotides away from one or both ends of the 5' extension domain.

Modifications in the 5' extension domain can be selected to not interfere with gRNA molecule efficacy, which can be evaluated by testing a candidate modification in the system described in Section V. gRNA's having a candidate 5' extension domain having a selected length, sequence, degree of complementarity, or degree of modification, can be evaluated in the system described at Section V. The candidate 5' extension domain can be placed, either alone, or with one or more other candidate changes in a gRNA molecule/Cas9 molecule system known to be functional with a selected target and evaluated.

In an embodiment, the 5' extension domain has at least 60, 70, 80, 85, 90 or 95% homology with, or differs by no more than 1, 2, 3, 4, 5, or 6 nucleotides from, a reference 5' extension domain, e.g., a naturally occurring, e.g., an *S. pyogenes*, *S. aureus*, or *S. thermophilus*, 5' extension domain, or a 5' extension domain described herein, e.g., from FIGS. 1A-1G.

Linking Domain

In a unimolecular gRNA molecule the linking domain is disposed between the first and second complementarity domains. In a modular gRNA molecule, the two molecules are associated with one another by the complementarity domains.

In an embodiment, the linking domain is 10+/-5, 20+/-5, 30+/-5, 40+/-5, 50+/-5, 60+/-5, 70+/-5, 80+/-5, 90+/-5, or 100+/-5 nucleotides, in length.

In an embodiment, the linking domain is 20+/-10, 30+/-10, 40+/-10, 50+/-10, 60+/-10, 70+/-10, 80+/-10, 90+/-10, or 100+/-10 nucleotides, in length.

In an embodiment, the linking domain is 10 to 100, 10 to 90, 10 to 80, 10 to 70, 10 to 60, 10 to 50, 10 to 40, 10 to 30, 10 to 20 or 10 to 15 nucleotides in length. In other embodiments, the linking domain is 20 to 100, 20 to 90, 20 to 80, 20 to 70, 20 to 60, 20 to 50, 20 to 40, 20 to 30, or 20 to 25 nucleotides in length.

In an embodiment, the linking domain is 1, 2, 3, 4, 5, 6, 7, 8, 9, 10, 11, 12, 13, 14, 15, 16 17, 18, 19, or 20 nucleotides in length.

In an embodiment, the linking domain is a covalent bond.

In an embodiment, the linking domain comprises a duplexed region, typically adjacent to or within 1, 2, or 3 nucleotides of the 3' end of the first complementarity domain and/or the 5-end of the second complementarity domain. In an embodiment, the duplexed region can be 20+/-10 base pairs in length. In an embodiment, the duplexed region can be 10+/-5, 15+/-5, 20+/-5, or 30+/-5 base pairs in length. In an embodiment, the duplexed region can be 1, 2, 3, 4, 5, 6, 7, 8, 9, 10, 11, 12, 13, 14, or 15 base pairs in length.

Typically the sequences forming the duplexed region have exact complementarity with one another, though in some embodiments as many as 1, 2, 3, 4, 5, 6, 7 or 8 nucleotides are not complementary with the corresponding nucleotides.

In an embodiment, the linking domain nucleotides do not comprise modifications, e.g., modifications of the type provided in Section VIII. However, in an embodiment, the linking domain comprises one or more modifications, e.g., modifications that it render it less susceptible to degradation or more bio-compatible, e.g., less immunogenic. By way of example, the backbone of the linking domain can be modified with a phosphorothioate, or other modification(s) from Section VIII. In an embodiment a nucleotide of the linking domain can comprise a 2' modification, e.g., a 2-acetylation, e.g., a 2' methylation, or other modification(s) from Section VIII. In some embodiments, the linking domain can comprise as many as 1, 2, 3, 4, 5, 6, 7 or 8 modifications.

Modifications in a linking domain can be selected to not interfere with targeting efficacy, which can be evaluated by testing a candidate modification in the system described in Section V. gRNA's having a candidate linking domain having a selected length, sequence, degree of complementarity, or degree of modification, can be evaluated a system described in Section V. A candidate linking domain can be placed, either alone, or with one or more other candidate changes in a gRNA molecule/Cas9 molecule system known to be functional with a selected target and evaluated.

In an embodiment, the linking domain has at least 60, 70, 80, 85, 90 or 95% homology with, or differs by no more than 1, 2, 3, 4, 5, or 6 nucleotides from, a reference linking domain, e.g., a linking domain described herein, e.g., from FIGS. 1A-1G.

Proximal Domain

In an embodiment, the proximal domain is 6+/-2, 7+/-2, 8+/-2, 9+/-2, 10+/-2, 11+/-2, 12+/-2, 13+/-2, 14+/-2, 14+/-2, 16+/-2, 17+/-2, 18+/-2, 19+/-2, or 20+/-2 nucleotides in length.

In an embodiment, the proximal domain is 6, 7, 8, 9, 10, 11, 12, 13, 14, 14, 16, 17, 18, 19, or 20 nucleotides in length.

In an embodiment, the proximal domain is 5 to 20, 7, to 18, 9 to 16, or 10 to 14 nucleotides in length.

In an embodiment, the proximal domain nucleotides do not comprise modifications, e.g., modifications of the type provided in Section VIII. However, in an embodiment, the proximal domain comprises one or more modifications, e.g., modifications that it render it less susceptible to degradation or more bio-compatible, e.g., less immunogenic. By way of example, the backbone of the proximal domain can be modified with a phosphorothioate, or other modification(s) from Section VIII. In an embodiment a nucleotide of the proximal domain can comprise a 2' modification, e.g., a 2-acetylation, e.g., a 2' methylation, or other modification(s) from Section VIII.

In some embodiments, the proximal domain can comprise as many as 1, 2, 3, 4, 5, 6, 7 or 8 modifications. In an embodiment, the proximal domain comprises as many as 1, 2, 3, or 4 modifications within 5 nucleotides of its 5' end, e.g., in a modular gRNA molecule. In an embodiment, the target domain comprises as many as 1, 2, 3, or 4 modifications within 5 nucleotides of its 3' end, e.g., in a modular gRNA molecule.

In some embodiments, the proximal domain comprises modifications at two consecutive nucleotides, e.g., two consecutive nucleotides that are within 5 nucleotides of the 5' end of the proximal domain, within 5 nucleotides of the 3' end of the proximal domain, or more than 5 nucleotides away from one or both ends of the proximal domain. In an embodiment, no two consecutive nucleotides are modified within 5 nucleotides of the 5' end of the proximal domain, within 5 nucleotides of the 3' end of the proximal domain, or within a region that is more than 5 nucleotides away from one or both ends of the proximal domain. In an embodiment, no nucleotide is modified within 5 nucleotides of the 5' end of the proximal domain, within 5 nucleotides of the 3' end of the proximal domain, or within a region that is more than 5 nucleotides away from one or both ends of the proximal domain.

Modifications in the proximal domain can be selected to not interfere with gRNA molecule efficacy, which can be evaluated by testing a candidate modification in the system described in Section V. gRNA's having a candidate proximal domain having a selected length, sequence, degree of complementarity, or degree of modification, can be evaluated in the system described at Section V. The candidate proximal domain can be placed, either alone, or with one or more other candidate changes in a gRNA molecule/Cas9 molecule system known to be functional with a selected target and evaluated.

In an embodiment, the proximal domain has at least 60, 70, 80, 85 90 or 95% homology with, or differs by no more than 1, 2, 3, 4, 5, or 6 nucleotides from, a reference proximal domain, e.g., a naturally occurring, e.g., an *S. pyogenes, S. aureus*, or *S. thermophilus*, proximal domain, or a proximal domain described herein, e.g., from FIGS. 1A-1G.

Tail Domain

In an embodiment, the tail domain is 10+/−5, 20+/−5, 30+/−5, 40+/−5, 50+/−5, 60+/−5, 70+/−5, 80+/−5, 90+/−5, or 100+/−5 nucleotides, in length.

In an embodiment, the tail domain is 20+/−5 nucleotides in length.

In an embodiment, the tail domain is 20+/−10, 30+/−10, 40+/−10, 50+/−10, 60+/−10, 70+/−10, 80+/−10, 90+/−10, or 100+/−10 nucleotides, in length.

In an embodiment, the tail domain is 25+/−10 nucleotides in length.

In an embodiment, the tail domain is 10 to 100, 10 to 90, 10 to 80, 10 to 70, 10 to 60, 10 to 50, 10 to 40, 10 to 30, 10 to 20 or 10 to 15 nucleotides in length.

In other embodiments, the tail domain is 20 to 100, 20 to 90, 20 to 80, 20 to 70, 20 to 60, 20 to 50, 20 to 40, 20 to 30, or 20 to 25 nucleotides in length.

In an embodiment, the tail domain is 1 to 20, 1 to 1, 1 to 10, or 1 to 5 nucleotides in length.

In an embodiment, the tail domain nucleotides do not comprise modifications, e.g., modifications of the type provided in Section VIII. However, in an embodiment, the tail domain comprises one or more modifications, e.g., modifications that it render it less susceptible to degradation or more bio-compatible, e.g., less immunogenic. By way of example, the backbone of the tail domain can be modified with a phosphorothioate, or other modification(s) from Section VIII. In an embodiment a nucleotide of the tail domain can comprise a 2' modification, e.g., a 2-acetylation, e.g., a 2' methylation, or other modification(s) from Section VIII.

In some embodiments, the tail domain can have as many as 1, 2, 3, 4, 5, 6, 7 or 8 modifications. In an embodiment, the target domain comprises as many as 1, 2, 3, or 4 modifications within 5 nucleotides of its 5' end. In an embodiment, the target domain comprises as many as 1, 2, 3, or 4 modifications within 5 nucleotides of its 3' end.

In an embodiment, the tail domain comprises a tail duplex domain, which can form a tail duplexed region. In an embodiment, the tail duplexed region can be 3, 4, 5, 6, 7, 8, 9, 10, 11, or 12 base pairs in length. In an embodiment, a further single stranded domain, exists 3' to the tail duplexed domain. In an embodiment, this domain is 3, 4, 5, 6, 7, 8, 9, or 10 nucleotides in length. In an embodiment it is 4 to 6 nucleotides in length.

In an embodiment, the tail domain has at least 60, 70, 80, or 90% homology with, or differs by no more than 1, 2, 3, 4, 5, or 6 nucleotides from, a reference tail domain, e.g., a naturally occurring, e.g., an *S. pyogenes*, or *S. thermophilus*, tail domain, or a tail domain described herein, e.g., from FIGS. 1A-1G.

In an embodiment, the proximal and tail domain, taken together comprise the following sequences:

```
                                        (SEQ ID NO: 33)
AAGGCUAGUCCGUUAUCAACUUGAAAAAGUGGCACCGAGUCGGUGCU, (SEQ ID NO: 34)
AAGGCUAGUCCGUUAUCAACUUGAAAAAGUGGCACCGAGUCGGUGGUGC, (SEQ ID NO: 35)
AAGGCUAGUCCGUUAUCAACUUGAAAAAGUGGCACCGAGUCGGUGCGGAU
C, (SEQ ID NO: 36)
AAGGCUAGUCCGUUAUCAACUUGAAAAAGUG, (SEQ ID NO: 37)
AAGGCUAGUCCGUUAUCA,
or
                                        (SEQ ID NO: 38)
AAGGCUAGUCCG.
```

In an embodiment, the tail domain comprises the 3' sequence UUUUUU, e.g., if a U6 promoter is used for transcription.

In an embodiment, the tail domain comprises the 3' sequence UUUU, e.g., if an H1 promoter is used for transcription.

In an embodiment, tail domain comprises variable numbers of 3' Us depending, e.g., on the termination signal of the pol-III promoter used.

In an embodiment, the tail domain comprises variable 3' sequence derived from the DNA template if a T7 promoter is used.

In an embodiment, the tail domain comprises variable 3' sequence derived from the DNA template, e.g., if in vitro transcription is used to generate the RNA molecule.

In an embodiment, the tail domain comprises variable 3' sequence derived from the DNA template, e., if a pol-II promoter is used to drive transcription.

Modifications in the tail domain can be selected to not interfere with targeting efficacy, which can be evaluated by testing a candidate modification in the system described in Section V. gRNAs having a candidate tail domain having a selected length, sequence, degree of complementarity, or degree of modification, can be evaluated in the system described in Section V. The candidate tail domain can be placed, either alone, or with one or more other candidate changes in a gRNA molecule/Cas9 molecule system known to be functional with a selected target and evaluated.

In some embodiments, the tail domain comprises modifications at two consecutive nucleotides, e.g., two consecutive nucleotides that are within 5 nucleotides of the 5' end of the tail domain, within 5 nucleotides of the 3' end of the tail domain, or more than 5 nucleotides away from one or both ends of the tail domain. In an embodiment, no two consecutive nucleotides are modified within 5 nucleotides of the 5' end of the tail domain, within 5 nucleotides of the 3' end of the tail domain, or within a region that is more than 5 nucleotides away from one or both ends of the tail domain. In an embodiment, no nucleotide is modified within 5 nucleotides of the 5' end of the tail domain, within 5 nucleotides of the 3' end of the tail domain, or within a region that is more than 5 nucleotides away from one or both ends of the tail domain.

In an embodiment a gRNA has the following structure:

5' [targeting domain]-[first complementarity domain]-[linking domain]-[second complementarity domain]-[proximal domain]-[tail domain]-3' wherein, the targeting domain comprises a core domain and optionally a secondary domain, and is 10 to 50 nucleotides in length;

the first complementarity domain is 5 to 25 nucleotides in length and, In an embodiment has at least 50, 60, 70, 80, 85, 90 or 95% homology with a reference first complementarity domain disclosed herein;

the linking domain is 1 to 5 nucleotides in length;

the proximal domain is 5 to 20 nucleotides in length and, in an embodiment has at least 50, 60, 70, 80, 85, 90 or 95% homology with a reference proximal domain disclosed herein; and the tail domain is absent or a nucleotide sequence is 1 to 50 nucleotides in length and, in an embodiment has at least 50, 60, 70, 80, 85, 90 or 95% homology with a reference tail domain disclosed herein.

Exemplary Chimeric gRNAs

In an embodiment, a unimolecular, or chimeric, gRNA comprises, preferably from 5' to 3':

a targeting domain, e.g., comprising 15, 16, 17, 18, 19, 20, 21, 22, 23, 24, 25, or 26 nucleotides (which is complementary to a target nucleic acid);

a first complementarity domain;

a linking domain;

a second complementarity domain (which is complementary to the first complementarity domain);

a proximal domain; and a tail domain, wherein, (a) the proximal and tail domain, when taken together, comprise at least 15, 18, 20, 25, 30, 31, 35, 40, 45, 49, 50, or 53 nucleotides;

(b) there are at least 15, 18, 20, 25, 30, 31, 35, 40, 45, 49, 50, or 53 nucleotides 3' to the last nucleotide of the second complementarity domain; or (c) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the sequence from (a), (b), or (c), has at least 60, 75, 80, 85, 90, 95, or 99% homology with the corresponding sequence of a naturally occurring gRNA, or with a gRNA described herein.

In an embodiment, the proximal and tail domain, when taken together, comprise at least 15, 18, 20, 25, 30, 31, 35, 40, 45, 49, 50, or 53 nucleotides.

In an embodiment, there are at least 15, 18, 20, 25, 30, 31, 35, 40, 45, 49, 50, or 53 nucleotides 3' to the last nucleotide of the second complementarity domain.

In an embodiment, there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 16, 17, 18, 19, 20, 21, 22, 23, 24, 25 or 26 nucleotides (e.g., 16, 17, 18, 19, 20, 21, 22, 23, 24, 25 or 26 consecutive nucleotides) having complementarity with the target domain, e.g., the targeting domain is 16, 17, 18, 19, 20, 21, 22, 23, 24, 25 or 26 nucleotides in length.

In an embodiment, the targeting domain comprises, has, or consists of, 16 nucleotides (e.g., 16 consecutive nucleotides) having complementarity with the target domain, e.g., the targeting domain is 16 nucleotides in length.

In an embodiment, the targeting domain comprises, has, or consists of, 17 nucleotides (e.g., 17 consecutive nucleotides) having complementarity with the target domain, e.g., the targeting domain is 17 nucleotides in length.

In an embodiment, the targeting domain comprises, has, or consists of, 18 nucleotides (e.g., 18 consecutive nucleotides) having complementarity with the target domain, e.g., the targeting domain is 18 nucleotides in length.

In an embodiment, the targeting domain comprises, has, or consists of, 19 nucleotides (e.g., 19 consecutive nucleotides) having complementarity with the target domain, e.g., the targeting domain is 19 nucleotides in length.

In an embodiment, the targeting domain comprises, has, or consists of, 20 nucleotides (e.g., 20 consecutive nucleotides) having complementarity with the target domain, e.g., the targeting domain is 20 nucleotides in length.

In an embodiment, the targeting domain comprises, has, or consists of, 21 nucleotides (e.g., 21 consecutive nucleotides) having complementarity with the target domain, e.g., the targeting domain is 21 nucleotides in length.

In an embodiment, the targeting domain comprises, has, or consists of, 22 nucleotides (e.g., 22 consecutive nucleotides) having complementarity with the target domain, e.g., the targeting domain is 22 nucleotides in length.

In an embodiment, the targeting domain comprises, has, or consists of, 23 nucleotides (e.g., 23 consecutive nucleotides) having complementarity with the target domain, e.g., the targeting domain is 23 nucleotides in length.

In an embodiment, the targeting domain comprises, has, or consists of, 24 nucleotides (e.g., 24 consecutive nucleotides) having complementarity with the target domain, e.g., the targeting domain is 24 nucleotides in length.

In an embodiment, the targeting domain comprises, has, or consists of, 25 nucleotides (e.g., 25 consecutive nucleotides) having complementarity with the target domain, e.g., the targeting domain is 25 nucleotides in length.

In an embodiment, the targeting domain comprises, has, or consists of, 26 nucleotides (e.g., 26 consecutive nucleotides) having complementarity with the target domain, e.g., the targeting domain is 26 nucleotides in length.

In an embodiment, the targeting domain comprises, has, or consists of, 16 nucleotides (e.g., 16 consecutive nucleotides) having complementarity with the target domain, e.g., the targeting domain is 16 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 16 nucleotides (e.g., 16 consecutive nucleotides) having complementarity with the target domain, e.g., the targeting domain is 16 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 16 nucleotides (e.g., 16 consecutive nucleotides) having complementarity with the target domain, e.g., the targeting domain is 16 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 17 nucleotides (e.g., 17 consecutive nucleotides) having complementarity with the target domain, e.g., the targeting domain is 17 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 17 nucleotides (e.g., 17 consecutive nucleotides) having complementarity with the target domain, e.g., the targeting domain is 17 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 17 nucleotides (e.g., 17 consecutive nucleotides) having complementarity with the target domain, e.g., the targeting domain is 17 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 18 nucleotides (e.g., 18 consecutive nucleotides) having complementarity with the target domain, e.g., the targeting domain is 18 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 18 nucleotides (e.g., 18 consecutive nucleotides) having complementarity with the target domain, e.g., the targeting domain is 18 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 18 nucleotides (e.g., 18 consecutive nucleotides) having complementarity with the target domain, e.g., the targeting domain is 18 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 19 nucleotides (e.g., 19 consecutive nucleotides) having complementarity with the target domain, e.g., the targeting domain is 19 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 19 nucleotides (e.g., 19 consecutive nucleotides) having complementarity with the target domain, e.g., the targeting domain is 19 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 19 nucleotides (e.g., 19 consecutive nucleotides) having complementarity with the target domain, e.g., the targeting domain is 19 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 20 nucleotides (e.g., 20 consecutive nucleotides) having complementarity with the target domain, e.g., the targeting domain is 20 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 20 nucleotides (e.g., 20 consecutive nucleotides) having complementarity with the target domain, e.g., the targeting domain is 20 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 20 nucleotides (e.g., 20 consecutive nucleotides) having complementarity with the target domain, e.g., the targeting domain is 20 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 21 nucleotides (e.g., 21 consecutive nucleotides) having complementarity with the target domain, e.g., the targeting domain is 21 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 21 nucleotides (e.g., 21 consecutive nucleotides) having complementarity with the target domain, e.g., the targeting domain is 21 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 21 nucleotides (e.g., 21 consecutive nucleotides) having complementarity with the target domain, e.g., the targeting domain is 21 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 22 nucleotides (e.g., 22 consecutive nucleotides) having complementarity with the target domain, e.g., the targeting domain is 22 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 22 nucleotides (e.g., 22 consecutive nucleotides) having complementarity with the target domain, e.g., the targeting domain is 22 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 22 nucleotides (e.g., 22 consecutive nucleotides) having complementarity with the target domain, e.g., the targeting domain is 22 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 23 nucleotides (e.g., 23 consecutive nucleotides) having complementarity with the target domain, e.g., the targeting domain is 23 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 23 nucleotides (e.g., 23 consecutive nucleotides) having complementarity with the target domain, e.g., the targeting domain is 23 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 23 nucleotides (e.g., 23 consecutive nucleotides) having complementarity with the target domain, e.g., the targeting domain is 23 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 24 nucleotides (e.g., 24 consecutive nucleotides) having complementarity with the target domain, e.g., the targeting domain is 24 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 24 nucleotides (e.g., 24 consecutive nucleotides) having complementarity with the target domain, e.g., the targeting domain is 24 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 24 nucleotides (e.g., 24 consecutive nucleotides) having complementarity with the target domain, e.g., the targeting domain is 24 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 25 nucleotides (e.g., 25 consecutive nucleotides) having complementarity with the target domain, e.g., the targeting domain is 25 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 25 nucleotides (e.g., 25 consecutive nucleotides) having complementarity with the target domain, e.g., the targeting domain is 25 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 25 nucleotides (e.g., 25 consecutive nucleotides) having complementarity with the target domain, e.g., the targeting domain is 25 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 26 nucleotides (e.g., 26 consecutive nucleotides) having complementarity with the target domain, e.g., the targeting domain is 26 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 26 nucleotides (e.g., 26 consecutive nucleotides) having complementarity with the target domain, e.g., the targeting domain is 26 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 26 nucleotides (e.g., 26 consecutive nucleotides) having complementarity with the target domain, e.g., the targeting domain is 26 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the unimolecular, or chimeric, gRNA molecule (comprising a targeting domain, a first complementary domain, a linking domain, a second complementary domain, a proximal domain and, optionally, a tail domain) comprises the following sequence in which the targeting domain is depicted as 20 Ns but could be any sequence and range in length from 16 to 26 nucleotides and in which the gRNA sequence is followed by 6 Us, which serve as a termination signal for the U6 promoter, but which could be either absent or fewer in number: NNNNNNNNNNNNNNNNNNNNGUUUUAGAGCUAGAAAUAGCAAGUUAAAAUAAGGCUAGUCCGUUAUCAACUUGAAAAAGUGGCACCGAGUCGGUGCUUUUUU (SEQ ID NO: 45). In an embodiment, the unimolecular, or chimeric, gRNA molecule is a *S. pyogenes* gRNA molecule.

In some embodiments, the unimolecular, or chimeric, gRNA molecule (comprising a targeting domain, a first complementary domain, a linking domain, a second complementary domain, a proximal domain and, optionally, a tail domain) comprises the following sequence in which the targeting domain is depicted as 20 Ns but could be any sequence and range in length from 16 to 26 nucleotides and in which the gRNA sequence is followed by 6 Us, which serve as a termination signal for the U6 promoter, but which could be either absent or fewer in number: NNNNNNNNNNNNNNNNNNNNGUUUUAGUACUCUGGAAACAGAAUCUACUAAAAC AAGGCAAAAUGCCGUGUUUAUCUCGUCAACUUGUUGGCGAGAUUUUUU (SEQ ID NO: 2779) (corresponding DNA sequence in SEQ ID NO: 2785). In an embodiment, the unimolecular, or chimeric, gRNA molecule is a *S. aureus* gRNA molecule.

Figure 18A:
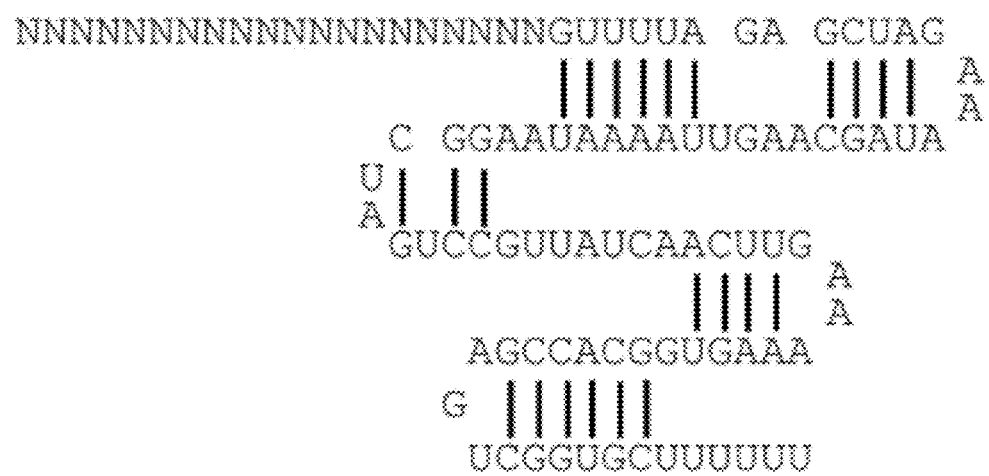
FIG. 18A-18B depicts additional exemplary structures of unimolecular gRNA molecules.
Figure 18B:
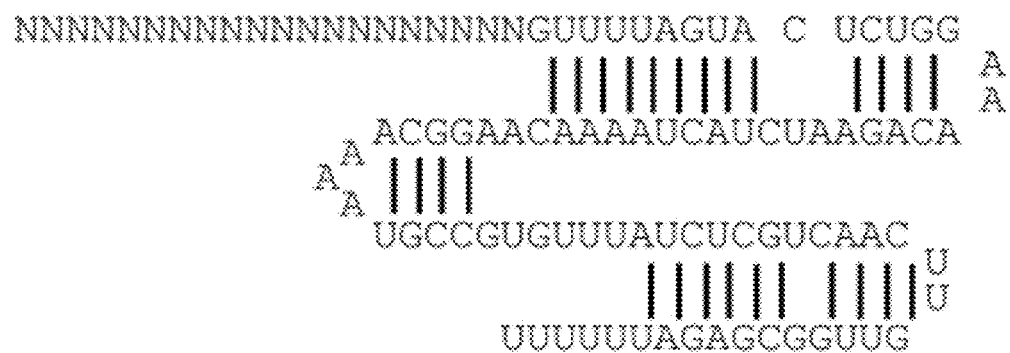

The sequences and structures of exemplary chimeric gRNAs of SEQ ID NOs: 45 and 2779 are shown in FIGS. 18A-18B, respectively.

Exemplary Modular gRNAs

In an embodiment, a modular gRNA comprises:
a first strand comprising, preferably from 5' to 3':
a targeting domain, e.g., comprising 15, 16, 17, 18, 19, 20, 21, 22, 23, 24, 25, or 26 nucleotides;
a first complementarity domain; and
a second strand, comprising, preferably from 5' to 3':
optionally a 5' extension domain;
a second complementarity domain;

a proximal domain; and a tail domain, wherein:

(a) the proximal and tail domain, when taken together, comprise at least 15, 18, 20, 25, 30, 31, 35, 40, 45, 49, 50, or 53 nucleotides;

(b) there are at least 15, 18, 20, 25, 30, 31, 35, 40, 45, 49, 50, or 53 nucleotides 3' to the last nucleotide of the second complementarity domain; or (c) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the sequence from (a), (b), or (c), has at least 60, 75, 80, 85, 90, 95, or 99% homology with the corresponding sequence of a naturally occurring gRNA, or with a gRNA described herein.

In an embodiment, the proximal and tail domain, when taken together, comprise at least 15, 18, 20, 25, 30, 31, 35, 40, 45, 49, 50, or 53 nucleotides.

In an embodiment, there are at least 15, 18, 20, 25, 30, 31, 35, 40, 45, 49, 50, or 53 nucleotides 3' to the last nucleotide of the second complementarity domain.

In an embodiment, there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 16, 17, 18, 19, 20, 21, 22, 23, 24, 25 or 26 nucleotides (e.g., 16, 17, 18, 19, 20, 21, 22, 23, 24, 25 or 26 consecutive nucleotides) having complementarity with the target domain, e.g., the targeting domain is 16, 17, 18, 19, 20, 21, 22, 23, 24, 25 or 26 nucleotides in length.

In an embodiment, the targeting domain comprises, has, or consists of, 16 nucleotides (e.g., 16 consecutive nucleotides) having complementarity with the target domain, e.g., the targeting domain is 16 nucleotides in length.

In an embodiment, the targeting domain comprises, has, or consists of, 17 nucleotides (e.g., 17 consecutive nucleotides) having complementarity with the target domain, e.g., the targeting domain is 17 nucleotides in length.

In an embodiment, the targeting domain comprises, has, or consists of, 18 nucleotides (e.g., 18 consecutive nucleotides) having complementarity with the target domain, e.g., the targeting domain is 18 nucleotides in length.

In an embodiment, the targeting domain comprises, has, or consists of, 19 nucleotides (e.g., 19 consecutive nucleotides) having complementarity with the target domain, e.g., the targeting domain is 19 nucleotides in length.

In an embodiment, the targeting domain comprises, has, or consists of, 20 nucleotides (e.g., 20 consecutive nucleotides) having complementarity with the target domain, e.g., the targeting domain is 20 nucleotides in length.

In an embodiment, the targeting domain comprises, has, or consists of, 21 nucleotides (e.g., 21 consecutive nucleotides) having complementarity with the target domain, e.g., the targeting domain is 21 nucleotides in length.

In an embodiment, the targeting domain comprises, has, or consists of, 22 nucleotides (e.g., 22 consecutive nucleotides) having complementarity with the target domain, e.g., the targeting domain is 22 nucleotides in length.

In an embodiment, the targeting domain comprises, has, or consists of, 23 nucleotides (e.g., 23 consecutive nucleotides) having complementarity with the target domain, e.g., the targeting domain is 23 nucleotides in length.

In an embodiment, the targeting domain comprises, has, or consists of, 24 nucleotides (e.g., 24 consecutive nucleotides) having complementarity with the target domain, e.g., the targeting domain is 24 nucleotides in length.

In an embodiment, the targeting domain comprises, has, or consists of, 25 nucleotides (e.g., 25 consecutive nucleotides) having complementarity with the target domain, e.g., the targeting domain is 25 nucleotides in length.

In an embodiment, the targeting domain comprises, has, or consists of, 26 nucleotides (e.g., 26 consecutive nucleotides) having complementarity with the target domain, e.g., the targeting domain is 26 nucleotides in length.

In an embodiment, the targeting domain comprises, has, or consists of, 16 nucleotides (e.g., 16 consecutive nucleotides) having complementarity with the target domain, e.g., the targeting domain is 16 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 16 nucleotides (e.g., 16 consecutive nucleotides) having complementarity with the target domain, e.g., the targeting domain is 16 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 16 nucleotides (e.g., 16 consecutive nucleotides) having complementarity with the target domain, e.g., the targeting domain is 16 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 17 nucleotides (e.g., 17 consecutive nucleotides) having complementarity with the target domain, e.g., the targeting domain is 17 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 17 nucleotides (e.g., 17 consecutive nucleotides) having complementarity with the target domain, e.g., the targeting domain is 17 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 17 nucleotides (e.g., 17 consecutive nucleotides) having complementarity with the target domain, e.g., the targeting domain is 17 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 18 nucleotides (e.g., 18 consecutive nucleotides) having complementarity with the target domain, e.g., the targeting domain is 18 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 18 nucleotides (e.g., 18 consecutive nucleotides) having complementarity with the target domain, e.g., the targeting domain is 18 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 18 nucleotides (e.g., 18 consecutive nucleotides) having complementarity with the target domain, e.g., the targeting domain is 18 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 19 nucleotides (e.g., 19 consecutive nucleotides) having complementarity with the target domain, e.g., the targeting domain is 19 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 19 nucleotides (e.g., 19 consecutive nucleotides) having complementarity with the target domain, e.g., the targeting domain is 19 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 19 nucleotides (e.g., 19 consecutive nucleotides) having complementarity with the target domain, e.g., the targeting domain is 19 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 20 nucleotides (e.g., 20 consecutive nucleotides) having complementarity with the target domain, e.g., the targeting domain is 20 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 20 nucleotides (e.g., 20 consecutive nucleotides) having complementarity with the target domain, e.g., the targeting domain is 20 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 20 nucleotides (e.g., 20 consecutive nucleotides) having complementarity with the target domain, e.g., the targeting domain is 20 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 21 nucleotides (e.g., 21 consecutive nucleotides) having complementarity with the target domain, e.g., the targeting domain is 21 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 21 nucleotides (e.g., 21 consecutive nucleotides) having complementarity with the target domain, e.g., the targeting domain is 21 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 21 nucleotides (e.g., 21 consecutive nucleotides) having complementarity with the target domain, e.g., the targeting domain is 21 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 22 nucleotides (e.g., 22 consecutive nucleotides) having complementarity with the target domain, e.g., the targeting domain is 22 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 22 nucleotides (e.g., 22 consecutive nucleotides) having complementarity with the target domain, e.g., the targeting domain is 22 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 22 nucleotides (e.g., 22 consecutive nucleotides) having complementarity with the target domain, e.g., the targeting domain is 22 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 23 nucleotides (e.g., 23 consecutive nucleotides) having complementarity with the target domain, e.g., the targeting domain is 23 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 23 nucleotides (e.g., 23 consecutive nucleotides) having complementarity with the target domain, e.g., the targeting domain is 23 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 23 nucleotides (e.g., 23 consecutive nucleotides) having complementarity with the target domain, e.g., the targeting domain is 23 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 24 nucleotides (e.g., 24 consecutive nucleotides) having complementarity with the target domain, e.g., the targeting domain is 24 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 24 nucleotides (e.g., 24 consecutive nucleotides) having complementarity with the target domain, e.g., the targeting domain is 24 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 24 nucleotides (e.g., 24 consecutive nucleotides) having complementarity with the target domain, e.g., the targeting domain is 24 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 25 nucleotides (e.g., 25 consecutive nucleotides) having complementarity with the target domain, e.g., the targeting domain is 25 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 25 nucleotides (e.g., 25 consecutive nucleotides) having complementarity with the target domain, e.g., the targeting domain is 25 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 25 nucleotides (e.g., 25 consecutive nucleotides) having complementarity with the target domain, e.g., the targeting domain is 25 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 26 nucleotides (e.g., 26 consecutive nucleotides) having complementarity with the target domain, e.g., the targeting domain is 26 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 26 nucleotides (e.g., 26 consecutive nucleotides) having complementarity with the target domain, e.g., the targeting domain is 26 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 26 nucleotides (e.g., 26 consecutive nucleotides) having complementarity with the target domain, e.g., the targeting domain is 26 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

gRNA Modifications

The activity, stability, or other characteristics of gRNAs can be altered through the incorporation of chemical and/or sequential modifications. As one example, transiently expressed or delivered nucleic acids can be prone to degradation by, e.g., cellular nucleases. Accordingly, the gRNAs described herein can contain one or more modified nucleosides or nucleotides which introduce stability toward nucleases. While not wishing to be bound by theory it is also believed that certain modified gRNAs described herein can exhibit a reduced innate immune response when introduced into a population of cells, particularly the cells of the present invention. As noted above, the term "innate immune response" includes a cellular response to exogenous nucleic acids, including single stranded nucleic acids, generally of viral or bacterial origin, which involves the induction of cytokine expression and release, particularly the interferons, and cell death.

One common 3' end modification is the addition of a poly A tract comprising one or more (and typically 5-200) adenine (A) residues. The poly A tract can be contained in the nucleic acid sequence encoding the gRNA, or can be added to the gRNA during chemical synthesis, or following in vitro transcription using a polyadenosine polymerase (e.g., E. coli Poly(A)Polymerase). In vivo, poly-A tracts can be added to sequences transcribed from DNA vectors through the use of polyadenylation signals. Examples of such signals are provided in Maeder.

III. Methods for Designing gRNAs

Methods for designing gRNAs are described herein, including methods for selecting, designing and validating target domains. Exemplary targeting domains are also provided herein. Targeting Domains discussed herein can be incorporated into the gRNAs described herein.

Methods for selection and validation of target sequences as well as off-target analyses are described, e.g., in Mali 2013; Hsu 2013; Fu 2014; Heigwer 2014; Bae 2014; Xiao 2014.

For example, a software tool can be used to optimize the choice of gRNA within a user's target sequence, e.g., to minimize total off-target activity across the genome. Off target activity may be other than cleavage. For each possible gRNA choice using *S. pyogenes* Cas9, software tools can identify all potential off-target sequences (preceding either NAG or NGG PAMs) across the genome that contain up to a certain number (e.g., 1, 2, 3, 4, 5, 6, 7, 8, 9, or 10) of mismatched base-pairs. The cleavage efficiency at each off-target sequence can be predicted, e.g., using an experimentally-derived weighting scheme. Each possible gRNA can then ranked according to its total predicted off-target cleavage; the top-ranked gRNAs represent those that are likely to have the greatest on-target and the least off-target cleavage. Other functions, e.g., automated reagent design for gRNA vector construction, primer design for the on-target Surveyor assay, and primer design for high-throughput detection and quantification of off-target cleavage via next-generation sequencing, can also be included in the tool. Candidate gRNA molecules can be evaluated by art-known methods or as described in Section V herein.

Guide RNAs (gRNAs) for use with *S. pyogenes, S. aureus* and *N. meningitidis* Cas9s were identified using a DNA sequence searching algorithm. Guide RNA design was carried out using a custom guide RNA design software based on the public tool cas-offinder (Bae 2014). Said custom guide RNA design software scores guides after calculating their genomewide off-target propensity. Typically matches ranging from perfect matches to 7 mismatches are considered for guides ranging in length from 17 to 24. Once the off-target sites are computationally determined, an aggregate score is calculated for each guide and summarized in a tabular output using a web-interface. In addition to identifying potential gRNA sites adjacent to PAM sequences, the software also identifies all PAM adjacent sequences that differ by 1, 2, 3 or more nucleotides from the selected gRNA sites. Genomic DNA sequence for each gene was obtained from the UCSC Genome browser and sequences were screened for repeat elements using the publically available RepeatMasker program. RepeatMasker searches input DNA sequences for repeated elements and regions of low complexity. The output is a detailed annotation of the repeats present in a given query sequence.

Following identification, gRNAs were ranked into tiers based on their distance to the target site, their orthogonality and presence of a 5' G (based on identification of close matches in the human genome containing a relevant PAM, e.g., in the case of *S. pyogenes*, a NGG PAM, in the case of *S. aureus*, NNGRR (e.g., a NNGRRT or NNGRRV) PAM, and in the case of *N. meningitides*, a NNNNGATT or NNNNGCTT PAM. Orthogonality refers to the number of sequences in the human genome that contain a minimum number of mismatches to the target sequence. A "high level of orthogonality" or "good orthogonality" may, for example, refer to 20-mer gRNAs that have no identical sequences in the human genome besides the intended target, nor any sequences that contain one or two mismatches in the target sequence. Targeting domains with good orthogonality are selected to minimize off-target DNA cleavage.

As an example, for *S. pyogenes* and *N. meningitides* targets, 17-mer, or 20-mer gRNAs were designed. As another example, for *S. aureus* targets, 18-mer, 19-mer, 20-mer, 21-mer, 22-mer, 23-mer and 24-mer gRNAs were designed. Targeting domains, disclosed herein, may comprises the 17-mer described in Tables 2A-2D, Tables 3A-3C, Tables 4A-4D, Tables 5A-5D, Tables 6A-6B, Tables 7A-7D, Tables 8A-8D, Tables 9A-9E, Tables 10A-10B, or Table 11, e.g., the targeting domains of 18 or more nucleotides may comprise the 17-mer gRNAs described in Tables 2A-2D, Tables 3A-3C, Tables 4A-4D, Tables 5A-5D, Tables 6A-6B, Tables 7A-7D, Tables 8A-8D, Tables 9A-9E, Tables 10A-10B, or Table 11. Targeting domains, disclosed herein, may comprises the 18-mer described in Tables 2A-2D, Tables 3A-3C, Tables 4A-4D, Tables 5A-5D, Tables 6A-6B, Tables 7A-7D, Tables 8A-8D, Tables 9A-9E, Tables 10A-10B, or Table 11, e.g., the targeting domains of 19 or more nucleotides may comprise the 18-mer gRNAs described in Tables 2A-2D, Tables 3A-3C, Tables 4A-4D, Tables 5A-5D, Tables 6A-6B, Tables 7A-7D, Tables 8A-8D, Tables 9A-9E, Tables 10A-10B, or Table 11. Targeting domains, disclosed herein, may comprises the 19-mer described in Tables 2A-2D, Tables 3A-3C, Tables 4A-4D, Tables 5A-5D, Tables 6A-6B, Tables 7A-7D, Tables 8A-8D, Tables 9A-9E, Tables 10A-10B, or Table 11, e.g., the targeting domains of 20 or more nucleotides may comprise the 19-mer gRNAs described in Tables 2A-2D, Tables 3A-3C, Tables 4A-4D, Tables 5A-5D, Tables 6A-6B, Tables 7A-7D, Tables 8A-8D, Tables 9A-9E, Tables 10A-10B, or Table 11. Targeting domains, disclosed herein, may comprises the 20-mer gRNAs described in Tables 2A-2D, Tables 3A-3C, Tables 4A-4D, Tables 5A-5D, Tables 6A-6B, Tables 7A-7D, Tables 8A-8D, Tables 9A-9E, Tables 10A-10B, or Table 11, e.g., the targeting domains of 21 or more nucleotides may comprise the 20-mer gRNAs described in Tables 2A-2D, Tables 3A-3C, Tables 4A-4D, Tables 5A-5D, Tables 6A-6B, Tables 7A-7D, Tables 8A-8D, Tables 9A-9E, Tables 10A-10B, or Table 11. Targeting domains, disclosed herein, may comprises the 21-mer described in Tables 2A-2D, Tables 3A-3C, Tables 4A-4D, Tables 5A-5D, Tables 6A-6B, Tables 7A-7D, Tables 8A-8D, Tables 9A-9E, Tables 10A-10B, or Table 11, e.g., the targeting domains of 22 or more nucleotides may comprise the 21-mer gRNAs described in Tables 2A-2D, Tables 3A-3C, Tables 4A-4D, Tables 5A-5D, Tables 6A-6B, Tables 7A-7D, Tables 8A-8D, Tables 9A-9E, Tables 10A-10B, or Table 11. Targeting domains, disclosed herein, may comprises the 22-mer described in Tables 2A-2D, Tables 3A-3C, Tables 4A-4D, Tables 5A-5D, Tables 6A-6B, Tables 7A-7D, Tables 8A-8D, Tables 9A-9E, Tables 10A-10B, or Table 11, e.g., the targeting domains of 23 or more nucleotides may comprise the 22-mer gRNAs described in Tables 2A-2D, Tables 3A-3C, Tables 4A-4D, Tables 5A-5D, Tables 6A-6B, Tables 7A-7D, Tables 8A-8D, Tables 9A-9E, Tables 10A-10B, or Table 11. Targeting domains, disclosed herein, may comprises the 23-mer described in Tables 2A-2D, Tables 3A-3C, Tables 4A-4D, Tables 5A-5D, Tables 6A-6B, Tables 7A-7D, Tables 8A-8D, Tables 9A-9E, Tables 10A-10B, or Table 11, e.g., the targeting domains of 24 or more nucleotides may comprise the 23-mer gRNAs described in Tables 2A-2D, Tables 3A-3C, Tables 4A-4D, Tables 5A-5D, Tables 6A-6B, Tables 7A-7D, Tables 8A-8D, Tables 9A-9E, Tables 10A-10B, or Table 11. Targeting domains, disclosed herein, may comprises the 24-mer described in Tables 2A-2D, Tables 3A-3C, Tables 4A-4D, Tables 5A-5D, Tables 6A-6B, Tables 7A-7D, Tables 8A-8D, Tables 9A-9E, Tables 10A-10B, or Table 11, e.g., the targeting domains of 25 or more nucleotides may comprise the 24-mer gRNAs described in Tables 2A-2D, Tables 3A-3C, Tables 4A-4D, Tables 5A-5D, Tables 6A-6B, Tables 7A-7D, Tables 8A-8D, Tables 9A-9E, Tables 10A-10B, or Table 11.

gRNAs were identified for both single-gRNA nuclease cleavage and for a dual-gRNA paired "nickase" strategy. Criteria for selecting gRNAs and the determination for which gRNAs can be used for the dual-gRNA paired "nickase" strategy is based on two considerations:

1. gRNA pairs should be oriented on the DNA such that PAMs are facing out and cutting with the D10A Cas9 nickase will result in 5' overhangs.
2. An assumption that cleaving with dual nickase pairs will result in deletion of the entire intervening sequence at a reasonable frequency. However, cleaving with dual nickase pairs can also result in indel mutations at the site of only one of the gRNAs. Candidate pair members can be tested for how efficiently they remove the entire sequence versus causing indel mutations at the site of one gRNA.

The Targeting Domains discussed herein can be incorporated into the gRNAs described herein.

Three strategies were utilized to identify gRNAs for use with *S. pyogenes*, *S. aureus* and *N. meningitidis* Cas9 enzymes.

In one strategy, gRNAs were designed for use with *S. pyogenes* and *S. aureus* Cas9 enzymes to induce an indel mediated by NHEJ in close proximity to or including the LCA10 target position (e.g., c.2991+1655A to G). The gRNAs were identified and ranked into 4 tiers for *S. pyogenes* (Tables 2A-2D). The targeting domain for tier 1 gRNA molecules to be used with *S. pyogenes* Cas9 molecules were selected based on (1) a short distance to the target position, e.g., within 40 bp upstream and 40 bp downstream of the mutation, (2) a high level of orthogonality, and (3) the presence of a 5' G. For selection of tier 2 gRNAs, a short distance and high orthogonality were required but the presence of a 5'G was not required. Tier 3 uses the same distance restriction and the requirement for a 5'G, but removes the requirement of good orthogonality. Tier 4 uses the same distance restriction but removes the requirement of good orthogonality and the 5'G. The gRNAs were identified and ranked into 4 tiers for *S. aureus*, when the relevant PAM was NNGRR (Tables 3A-3C). The targeting domain for tier 1 gRNA molecules to be used with *S. pyogenes* Cas9 molecules were selected based on (1) a short distance to the target position, e.g., within 40 bp upstream and 40 bp downstream of the mutation, (2) a high level of orthogonality, and (3) the presence of a 5' G. For selection of tier 2 gRNAs, a short distance and high orthogonality were required but the presence of a 5'G was not required. Tier 3 uses the same distance restriction and the requirement for a 5'G, but removes the requirement of good orthogonality. Tier 4 uses the same distance restriction but removes the requirement of good orthogonality and the 5'G. The gRNAs were identified and ranked into 5 tiers for S. aureus when the relevant PAM was NNGRRT or NNGRRV (Tables 7A-7D). The targeting domain for tier 1 gRNA molecules to be used with S. aureus Cas9 molecules were selected based on (1) a short distance to the target position, e.g., within 40 bp upstream and 40 bp downstream of the mutation, (2) a high level of orthogonality, (3) the presence of a 5' G and (4) PAM was NNGRRT. For selection of tier 2 gRNAs, a short distance and high orthogonality were required but the presence of a 5'G was not required, and PAM was NNGRRT. Tier 3 uses the same distance restriction and the requirement for a 5'G, but removes the requirement of good orthogonality, and PAM was NNGRRT. Tier 4 uses the same distance restriction but removes the requirement of good orthogonality and the 5'G, and PAM was NNGRRT. Tier 5 required a short distance to the target position, e.g., within 40 bp upstream and 40 bp downstream of the mutation and PAM was NNGRRV. Note that tiers are non-inclusive (each gRNA is listed only once for the strategy). In certain instances, no gRNA was identified based on the criteria of the particular tier.

In a second strategy, gRNAs were designed for use with S. pyogenes, S. aureus and N. meningitidis Cas9 molecules to delete a genomic sequence including the mutation at the LCA10 target position (e.g., c.2991+1655A to G), e.g., mediated by NHEJ. The gRNAs were identified and ranked into 4 tiers for S. pyogenes (Tables 4A-4D). The targeting domain to be used with S. pyogenes Cas9 molecules for tier 1 gRNA molecules were selected based on (1) flanking the mutation without targeting unwanted chromosome elements, such as an Alu repeat, e.g., within 400 bp upstream of an Alu repeat or 700 bp downstream of mutation, (2) a high level of orthogonality, and (3) the presence of a 5' G. For selection of tier 2 gRNAs, a reasonable distance and high orthogonality were required but the presence of a 5'G was not required. Tier 3 uses the same distance restriction and the requirement for a 5'G, but removes the requirement of good orthogonality. Tier 4 uses the same distance restriction but removes the requirement of good orthogonality and the 5'G. The gRNAs were identified and ranked into 4 tiers for S. aureus, when the relevant PAM was NNGRR (Tables 5A-5D). The targeting domain to be used with S. aureus Cas9 molecules for tier 1 gRNA molecules were selected based on (1) flanking the mutation without targeting unwanted chromosome elements, such as an Alu repeat, e.g., within 400 bp upstream of an Alu repeat or 700 bp downstream of mutation, (2) a high level of orthogonality, and (3) the presence of a 5' G. For selection of tier 2 gRNAs, a reasonable distance and high orthogonality were required but the presence of a 5'G was not required. Tier 3 uses the same distance restriction and the requirement for a 5'G, but removes the requirement of good orthogonality. Tier 4 uses the same distance restriction but removes the requirement of good orthogonality and the 5'G. The gRNAs were identified and ranked into 2 tiers for N. meningitides (Tables 6A-6B). The targeting domain to be used with N. meningitides Cas9 molecules for tier 1 gRNA molecules were selected based on (1) flanking the mutation without targeting unwanted chromosome elements, such as an Alu repeat, e.g., within 400 bp upstream of an Alu repeat or 700 bp downstream of mutation, (2) a high level of orthogonality, and (3) the presence of a 5' G. For selection of tier 2 gRNAs, a reasonable distance and high orthogonality were required but the presence of a 5'G was not required. Note that tiers are non-inclusive (each gRNA is listed only once for the strategy). In certain instances, no gRNA was identified based on the criteria of the particular tier. In a third strategy, gRNAs were designed for use with S. pyogenes, S. aureus and N. meningitidis Cas9 molecules to delete a genomic sequence including the mutation at the LCA10 target position (e.g., c.2991+1655A to G), e.g., mediated by NHEJ. The gRNAs were identified and ranked into 4 tiers for S. pyogenes (Tables 8A-8D). The targeting domain to be used with S. pyogenes Cas9 enzymes for tier 1 gRNA molecules were selected based on (1) flanking the mutation without targeting unwanted chromosome elements, such as an Alu repeat, e.g., within 1000 bp upstream of an Alu repeat or 1000 bp downstream of mutation, (2) a high level of orthogonality, (3) the presence of a 5' G and (4) and PAM was NNGRRT. For selection of tier 2 gRNAs, a reasonable distance and high orthogonality were required but the presence of a 5'G was not required, and PAM was NNGRRT. Tier 3 uses the same distance restriction and the requirement for a 5'G, but removes the requirement of good orthogonality, and PAM was NNGRRT. Tier 4 uses the same distance restriction but removes the requirement of good orthogonality and the 5'G, and PAM was NNGRRT. The gRNAs were identified and ranked into 4 tiers for S. aureus, when the relevant PAM was NNGRRT or NNGRRV (Tables 9A-9E). The targeting domain to be used with S. aureus Cas9 enzymes for tier 1 gRNA molecules were selected based on (1) flanking the mutation without targeting unwanted chromosome elements, such as an Alu repeat, e.g., within 1000 bp upstream of an Alu repeat or 1000 bp downstream of mutation, (2) a high level of orthogonality, and (3) the presence of a 5' G. For selection of tier 2 gRNAs, a reasonable distance and high orthogonality were required but the presence of a 5'G was not required. Tier 3 uses the same distance restriction and the requirement for a 5'G, but removes the requirement of good orthogonality. Tier 4 uses the same distance restriction but removes the requirement of good orthogonality and the 5'G. Tier 5 used the same distance restriction and PAM was NNGRRV. The gRNAs were identified and ranked into 2 tiers for N. meningitides (Tables 10A-10B). The targeting domain to be used with N. meningitides Cas9 molecules for tier 1 gRNA molecules were selected based on (1) flanking the mutation without targeting unwanted chromosome elements, such as an Alu repeat, e.g., within 1000 bp upstream of an Alu repeat or 1000 bp downstream of mutation, (2) a high level of orthogonality, and (3) the presence of a 5' G. For selection of tier 2 gRNAs, a reasonable distance and high orthogonality were required but the presence of a 5'G was not required. Note that tiers are non-inclusive (each gRNA is listed only once for the strategy). In certain instances, no gRNA was identified based on the criteria of the particular tier.

In an embodiment, when a single gRNA molecule is used to target a Cas9 nickase to create a single strand break to introduce a break-induced indel in close proximity to or including the LCA10 target position, the gRNA is used to target either upstream of (e.g., within 40 bp upstream of the LCA10 target position), or downstream of (e.g., within 40 bp downstream of the LCA10 target position) in the CEP290 gene.

In an embodiment, when a single gRNA molecule is used to target a Cas9 nuclease to create a double strand break to introduce a break-induced indel in close proximity to or including the LCA10 target position, the gRNA is used to target either upstream of (e.g., within 40 bp upstream of the LCA10 target position), or downstream of (e.g., within 40 bp downstream of the LCA10 target position) in the CEP290 gene.

In an embodiment, dual targeting is used to create two double strand breaks to delete a genomic sequence including the mutation at the LCA10 target position, e.g., mediated by NHEJ. In an embodiment, the first and second gRNAs are used target two Cas9 nucleases to flank, e.g., the first of gRNA is used to target upstream of (e.g., within 400 bp upstream of the Alu repeat, or within 40 bp upstream of the LCA10 target position), and the second gRNA is used to target downstream of (e.g., within 700 bp downstream of the LCA10 target position) in the CEP290 gene.

In an embodiment, dual targeting is used to create a double strand break and a pair of single strand breaks to delete a genomic sequence including the mutation at the LCA10 target position, e.g., mediated by NHEJ. In an embodiment, the first, second and third gRNAs are used to target one Cas9 nuclease and two Cas9 nickases to flank, e.g., the first gRNA that will be used with the Cas9 nuclease is used to target upstream of (e.g., within 400 bp upstream of the Alu repeat, or within 40 bp upstream of the LCA10 target position) or downstream of (e.g., within 700 bp downstream) of the LCA10 target position, and the second and third gRNAs that will be used with the Cas9 nickase pair are used to target the opposite side of the LCA10 target position (e.g., within 400 bp upstream of the Alu repeat, within 40 bp upstream of the LCA10 target position, or within 700 bp downstream of the LCA10 target position) in the CEP290 gene.

In an embodiment, when four gRNAs (e.g., two pairs) are used to target four Cas9 nickases to create four single strand breaks to delete genomic sequence including the mutation at the LCA10 target position, e.g., mediated by NHEJ, the first pair and second pair of gRNAs are used to target four Cas9 nickases to flank, e.g., the first pair of gRNAs are used to target upstream of (e.g., within 400 bp upstream of the Alu repeat, or within 40 bp upstream of the LCA10 target position), and the second pair of gRNAs are used to target downstream of (e.g., within 700 bp downstream of the LCA10 target position) in the CEP290 gene.

In an embodiment, dual targeting is utilized to delete genomic sequence including the mutation at the LCA10 target position mediated by NHEJ. It is contemplated herein that in an embodiment any upstream gRNA (e.g., within 400 bp upstream of an Alu repeat, or within 40 bp upstream of the LCA10 target position) in Tables 2A-2C and Tables 4A-4D can be paired with any downstream gRNA (e.g., within 700 downstream of LCA10 target position) in Tables 4A-4D to be used with a *S. pyogenes* Cas9 molecule to generate dual targeting. Exemplary pairs including selecting a targeting domain that is labeled as upstream from Tables 2A-2C or Tables 4A-4D and a second targeting domain that is labeled as downstream from Tables 4A-4D. In an embodiment, a targeting domain that is labeled as upstream in Tables 2A-2C or Tables 4A-4D can be combined with any of the targeting domains that is labeled as downstream in Tables 4A-4D.

In an embodiment, dual targeting is utilized to delete genomic sequence including the mutation at the LCA10 target position mediated by NHEJ. It is contemplated herein that in an embodiment any upstream gRNA (e.g., within 400 bp upstream of an Alu repeat, or within 40 bp upstream of the LCA10 target position) in Tables 3A-3C and Tables 5A-5D can be paired with any downstream gRNA (e.g., within 700 downstream of LCA10 target position) in Tables 5A-5D to be used with a *S. aureus* Cas9 molecule to generate dual targeting. Exemplary pairs include selecting a targeting domain that is labeled as upstream from Tables 3A-3C or Tables 5A-5D and a second targeting domain that is labeled as downstream from Tables 5A-5D. In an embodiment, a targeting domain that is labeled as upstream in Tables 3A-3C or Tables 5A-5D can be combined with any of the targeting domains that is labeled as downstream in Tables 5A-5D.

In an embodiment, dual targeting is utilized to delete genomic sequence including the mutation at the LCA10 target position mediated by NHEJ. It is contemplated herein that in an embodiment any upstream gRNA (e.g., within 400 bp upstream of an Alu repeat, or within 40 bp upstream of the LCA10 target position) in Tables 6A-6B can be paired with any downstream gRNA (e.g., within 700 downstream of LCA10 target position) in Tables 6A-6B to be used with a *N. meningitidis* Cas9 molecule to generate dual targeting. Exemplary pairs include selecting a targeting domain that is labeled as upstream from Tables 6A-6B and a second targeting domain that is labeled as downstream from Tables 6A-6B. In an embodiment, a targeting domain that is labeled as upstream in Tables 6A-6B can be combined with any of the targeting domains that is labeled as downstream in Tables 6A-6B.

In an embodiment, dual targeting (e.g., dual double strand cleavage) is used to create two double strand breaks to delete a genomic sequence including the mutation at the LCA10 target position, e.g., mediated by NHEJ. In an embodiment, the first and second gRNAs are used target two Cas9 nucleases to flank, e.g., the first of gRNA is used to target upstream of (e.g., within 1000 bp upstream of the Alu repeat, or within 40 bp upstream of the LCA10 target position), and the second gRNA is used to target downstream of (e.g., within 1000 bp downstream of the LCA10 target position) in the CEP290 gene.

In an embodiment, dual targeting (e.g., dual double strand cleavage) is used to create a double strand break and a pair of single strand breaks to delete a genomic sequence including the mutation at the LCA10 target position, e.g., mediated by NHEJ. In an embodiment, the first, second and third gRNAs are used to target one Cas9 nuclease and two Cas9 nickases to flank, e.g., the first gRNA that will be used with the Cas9 nuclease is used to target upstream of (e.g., within 1000 bp upstream of the Alu repeat, or within 40 bp upstream of the LCA10 target position) or downstream of (e.g., within 1000 bp downstream) of the LCA10 target position, and the second and third gRNAs that will be used with the Cas9 nickase pair are used to target the opposite side of the LCA10 target position (e.g., within 1000 bp upstream of the Alu repeat, or within 40 bp upstream of the LCA10 target position or within 1000 bp downstream of the LCA10 target position) in the CEP290 gene.

In an embodiment, when four gRNAs (e.g., two pairs) are used to target four Cas9 nickases to create four single strand breaks to delete genomic sequence including the mutation at the LCA10 target position, e.g., mediated by NHEJ, the first pair and second pair of gRNAs are used to target four Cas9 nickases to flank, e.g., the first pair of gRNAs are used to target upstream of (e.g., within 1000 bp upstream of the Alu repeat, or within 40 bp upstream of the LCA10 target position), and the second pair of gRNAs are used to target downstream of (e.g., within 1000 bp downstream of the LCA10 target position) in the CEP290 gene.

In an embodiment, dual targeting is utilized to delete genomic sequence including the mutation at the LCA10 target position, e.g., mediated by NHEJ. It is contemplated herein that in an embodiment any upstream gRNA (e.g., within 1000 bp upstream of an Alu repeat, or within 40 bp upstream of the LCA10 target position) in Tables 2A-2C, Tables 4A-4D, or Tables 8A-8D can be paired with any downstream gRNA (e.g., within 1000 downstream of LCA10 target position) in Tables 2A-2C, Tables 4A-4D, or Tables 8A-8D to be used with a S. pyogenes Cas9 molecule to generate dual targeting. Exemplary pairs including selecting a targeting domain that is labeled as upstream from Tables 2A-2C, Tables 4A-4D, or Tables 8A-8D and a second targeting domain that is labeled as downstream from Tables 2A-2C, Tables 4A-4D, or Tables 8A-8D. In an embodiment, a targeting domain that is labeled as upstream in Tables 2A-2C, Tables 4A-4D, or Tables 8A-8D can be combined with any of the targeting domains that is labeled as downstream in Tables 2A-2C, Tables 4A-4D, or Tables 8A-8D.

In an embodiment, dual targeting is utilized to delete genomic sequence including the mutation at the LCA10 target position mediated by NHEJ. It is contemplated herein that in an embodiment any upstream gRNA (e.g., within 1000 bp upstream of an Alu repeat, or within 40 bp upstream of the LCA10 target position) in Tables 3A-3C, Tables 5A-5D, Tables 7A-7D, or Tables 9A-9E can be paired with any downstream gRNA (e.g., within 1000 downstream of LCA10 target position) in Tables 3A-3C, Tables 5A-5D, Tables 7A-7D, or Tables 9A-9E to be used with a S. aureus Cas9 molecule to generate dual targeting. Exemplary pairs include selecting a targeting domain that is labeled as upstream from Tables 3A-3C, Tables 5A-5D, Tables 7A-7D, or Tables 9A-9E and a second targeting domain that is labeled as downstream from Tables 3A-3C, Tables 5A-5D, Tables 7A-7D, or Tables 9A-9E. In an embodiment, a targeting domain that is labeled as upstream in Tables 3A-3C, Tables 5A-5D, Tables 7A-7D, or Tables 9A-9E can be combined with any of the targeting domains that is labeled as downstream in Tables 3A-3C, Tables 5A-5D, Tables 7A-7D, or Tables 9A-9E.

In an embodiment, dual targeting is utilized to delete genomic sequence including the mutation at the LCA10 target position, e.g., mediated by NHEJ. It is contemplated herein that in an embodiment any upstream gRNA (e.g., within 1000 bp upstream of an Alu repeat, or within 40 bp upstream of the LCA10 target position) in Tables 6A-6B or Tables 10A-10B can be paired with any downstream gRNA (e.g., within 1000 downstream of LCA10 target position) in Tables 6A-6D to be used with a N. meningitidis Cas9 molecule to generate dual targeting. Exemplary pairs include selecting a targeting domain that is labeled as upstream from Tables 6A-6B or Tables 10A-10B and a second targeting domain that is labeled as downstream from Tables 6A-6B or Tables 10A-10B. In an embodiment, a targeting domain that is labeled as upstream in Tables 6A-6B or Tables 10A-10B and can be combined with any of the targeting domains that is labeled as downstream in Tables 6A-6B or Tables 10A-10B.

Any of the targeting domains in the tables described herein can be used with a Cas9 nickase molecule to generate a single strand break.

Any of the targeting domains in the tables described herein can be used with a Cas9 nuclease molecule to generate a double strand break.

In an embodiment, dual targeting (e.g., dual nicking) is used to create two nicks on opposite DNA strands by using S. pyogenes, S. aureus and N. meningitidis Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp. Exemplary nickase pairs including selecting a targeting domain from Group A and a second targeting domain from Group B in Table 2D (for S. pyogenes), or selecting a targeting domain from Group A and a second targeting domain from Group B in Table 7D (for S. aureus). It is contemplated herein that in an embodiment a targeting domain of Group A can be combined with any of the targeting domains of Group B in Table 2D (for S. pyogenes). For example, CEP290-B5 or CEP290-B10 can be combined with CEP290-B1 or CEP290-B6. It is contemplated herein that in an embodiment a targeting domain of Group A can be combined with any of the targeting domains of Group B in Table 7D (for S. aureus). For example, CEP290-12 or CEP290-17 can be combined with CEP290-11 or CEP290-16.

In an embodiment, dual targeting (e.g., dual double strand cleavage) is used to create two double strand breaks by using S. pyogenes, S. aureus and N. meningitidis Cas9 nucleases with two targeting domains. It is contemplated herein that in an embodiment any upstream gRNA of any of Tables 2A-2C, Tables 3A-3C, Tables 4A-4D, Tables 5A-5D, Tables 6A-6B, Tables 7A-7C, Tables 8A-8D, Tables 9A-9E, or Tables 10A-10B can be paired with any downstream gRNA of any of Tables 2A-2C, Tables 3A-3C, Tables 4A-4D, Tables 5A-5D, Tables 6A-6B, Tables 7A-7C, Tables 8A-8D, Tables 9A-9E, or Tables 10A-10B. Exemplary nucleases pairs are shown in Table 11, e.g., CEP290-323 can be combined with CEP290-11, CEP290-323 can be combined with CEP290-64, CEP290-490 can be combined with CEP290-496, CEP290-490 can be combined with CEP290-502, CEP290-490 can be combined with CEP290-504, CEP290-492 can be combined with CEP290-502, or CEP290-492 can be combined with CEP290-504.

It is contemplated herein that any upstream gRNA described herein may be paired with any downstream gRNA described herein. When an upstream gRNA designed for use with one species of Cas9 is paired with a downstream gRNA designed for use from a different species of Cas9, both Cas9 species are used to generate a single or double-strand break, as desired.

Exemplary Targeting Domains

Table 2A provides targeting domains for NHEJ-mediated introduction of an indel in close proximity to or including the LCA10 target position in the CEP290 gene selected according to the first tier parameters. The targeting domains are within 40 bases of the LCA10 target position, have good orthogonality, and start with G. It is contemplated herein that the targeting domain hybridizes to the target domain through complementary base pairing. Any of the targeting domains in the table can be used with a S. pyogenes Cas9 molecule that generates a double stranded break (Cas9 nuclease) or a single-stranded break (Cas9 nickase).

TABLE 2A

| gRNA Name | DNA Strand | Targeting Domain | Target Site Length | Position relative to mutation |
|---|---|---|---|---|
| CEP290-B4 | + | GAGAUACUCACAAUUACAAC (SEQ ID NO: 395) | 20 | upstream |
| CEP290-B28 | + | GAUACUCACAAUUACAACUG (SEQ ID NO: 396) | 20 | upstream |

Table 2B provides targeting domains for NHEJ-mediated introduction of an indel in close proximity to or including the LCA10 target position in the CEP290 gene selected according to the second tier parameters. The targeting domains are within 40 bases of the LCA10 target position, have good orthogonality, and do not start with G. It is contemplated herein that the targeting domain hybridizes to the target domain through complementary base pairing. Any of the targeting domains in the table can be used with a *S. pyogenes* Cas9 molecule that generates a double stranded break (Cas9 nuclease) or a single-stranded break (Cas9 nickase).

TABLE 2B

| gRNA Name | DNA Strand | Targeting Domain | Target Site Length | Position relative to mutation |
|---|---|---|---|---|
| CEP290-B6 | − | CUCAUACCUAUCCCUAU (SEQ ID NO: 594) | 17 | downstream |
| CEP290-B20 | + | ACACUGCCAAUAGGGAU (SEQ ID NO: 595) | 17 | downstream |
| CEP290-B10 | + | CAAUUACAACUGGGGCC (SEQ ID NO: 596) | 17 | upstream |
| CEP290-B21 | + | CUAAGACACUGCCAAUA (SEQ ID NO: 597) | 17 | downstream |
| CEP290-B9 | + | AUACUCACAAUUACAAC (SEQ ID NO: 598) | 17 | upstream |
| CEP290-B1 | − | UAUCUCAUACCUAUCCCUAU (SEQ ID NO: 599) | 20 | downstream |
| CEP290-B29 | + | AAGACACUGCCAAUAGGGAU (SEQ ID NO: 600) | 20 | downstream |
| CEP290-B5 | + | UCACAAUUACAACUGGGGCC (SEQ ID NO: 601) | 20 | upstream |
| CEP290-B30 | + | AGAUACUCACAAUUACAACU (SEQ ID NO: 602) | 20 | upstream |

Table 2C provides targeting domains for NHEJ-mediated introduction of an indel in close proximity to or including the LCA10 target position in the CEP290 gene selected according to the fourth tier parameters. The targeting domains are within 40 bases of the LCA10 target position and do not start with G. It is contemplated herein that the targeting domain hybridizes to the target domain through complementary base pairing. Any of the targeting domains in the table can be used with a *S. pyogenes* Cas9 molecule that generates a double stranded break (Cas9 nuclease) or a single-stranded break (Cas9 nickase).

TABLE 2C

| gRNA Name | DNA Strand | Targeting Domain | Target Site Length | Position relative to mutation |
|---|---|---|---|---|
| CEP290-B22 | + | ACUAAGACACUGCCAAU (SEQ ID NO: 603) | 17 | downstream |
| CEP290-B23 | + | UACUCACAAUUACAACU (SEQ ID NO: 604) | 17 | upstream |
| CEP290-B24 | + | ACUCACAAUUACAACUG (SEQ ID NO: 605) | 17 | upstream |
| CEP290-B25 | + | ACAACUGGGGCCAGGUG (SEQ ID NO: 606) | 17 | upstream |
| CEP290-B26 | + | ACUGGGGCCAGGUGCGG (SEQ ID NO: 607) | 17 | upstream |
| CEP290-B27 | − | AUGUGAGCCACCGCACC (SEQ ID NO: 608) | 17 | upstream |
| CEP290-B31 | + | AAACUAAGACACUGCCAAUA (SEQ ID NO: 609) | 20 | downstream |
| CEP290-B32 | + | AAAACUAAGACACUGCCAAU (SEQ ID NO: 610) | 20 | upstream |
| CEP290-B33 | + | AUUACAACUGGGGCCAGGUG (SEQ ID NO: 611) | 20 | upstream |
| CEP290-B34 | + | ACAACUGGGGCCAGGUGCGG (SEQ ID NO: 612) | 20 | upstream |

Table 2D provides targeting domains for NHEJ-mediated introduction of an indel in close proximity to or including the LCA10 target position in the CEP290 gene that can be used for dual targeting. Any of the targeting domains in the table can be used with a *S. pyogenes* Cas9 (nickase) molecule to generate a single stranded break.

Exemplary nickase pairs including selecting a targeting domain from Group A and a second targeting domain from Group B. It is contemplated herein that a targeting domain of Group A can be combined with any of the targeting domains of Group B. For example, the CEP290-B5 or CEP290-B10 can be combined with CEP290-B1 or CEP290-B6.

TABLE 2D

| Group A | Group B |
|---|---|
| CEP290-B5 | CEP290-B1 |
| CEP290-B10 | CEP290-B6 |

Table 3A provides targeting domains for NHEJ-mediated introduction of an indel in close proximity to or including the LCA10 target position in the CEP290 gene selected according to the first tier parameters. The targeting domains are within 40 bases of the LCA10 target position, have good orthogonality, and start with G. It is contemplated herein that the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 3A

| gRNA Name | DNA Strand | Targeting Domain | Target Site Length | Position relative to mutation |
|---|---|---|---|---|
| CEP290-B1000 | + | GAGAUACUCACAAUUACAAC (SEQ ID NO: 395) | 20 | upstream |
| CEP290-B1001 | + | GAUACUCACAAUUACAA (SEQ ID NO: 397) | 17 | upstream |

Table 3B provides targeting domains for NHEJ-mediated introduction of an indel in close proximity to or including the LCA10 target position in the CEP290 gene selected according to the second tier parameters. The targeting domains are within 40 bases of the LCA10 target position, have good orthogonality, and do not start with G. It is contemplated herein that the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 3B

| gRNA Name | DNA Strand | Targeting Domain | Target Site Length | Position relative to mutation |
|---|---|---|---|---|
| CEP290-B1002 | + | CACUGCCAAUAGGGAUAGGU (SEQ ID NO: 613) | 20 | downstream |
| CEP290-B1003 | + | UGCCAAUAGGGAUAGGU (SEQ ID NO: 614) | 17 | downstream |
| CEP290-B1004 | + | UGAGAUACUCACAAUUACAA (SEQ ID NO: 615) | 20 | upstream |
| CEP290-B1005 | + | AUACUCACAAUUACAAC (SEQ ID NO: 598) | 17 | upstream |

Table 3C provides targeting domains for NHEJ-mediated introduction of an indel in close proximity to or including the LCA10 target position in the CEP290 gene selected according to the fourth tier parameters. The targeting domains are within 40 bases of the LCA10 target position, and do not start with G. It is contemplated herein that the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 3C

| gRNA Name | DNA Strand | Targeting Domain | Target Site Length | Position relative to mutation |
|---|---|---|---|---|
| CEP290-B1006 | − | ACCUGGCCCCAGUUGUAAUU (SEQ ID NO: 616) | 20 | upstream |
| CEP290-B1007 | − | UGGCCCCAGUUGUAAUU (SEQ ID NO: 617) | 17 | upstream |

Table 4A provides targeting domains for break-induced deletion of genomic sequence including the mutation at the LCA10 target position in the CEP290 gene selected according to the first tier parameters. The targeting domains are within 400 bp upstream of an Alu repeat or 700 bp downstream of the mutation, have good orthogonality, and start with G. It is contemplated herein that the targeting domain hybridizes to the target domain through complementary base pairing. Any of the targeting domains in the table can be used with a *S. pyogenes* Cas9 molecule that generates a double stranded break (Cas9 nuclease) or a single-stranded break (Cas9 nickase).

TABLE 4A

| gRNA Name | DNA Strand | Targeting Domain | Target Site Length | Position relative to mutation |
|---|---|---|---|---|
| CEP290-B8 | − | GCUACCGGUUACCUGAA (SEQ ID NO: 457) | 17 | downstream |
| CEP290-B217 | + | GCAGAACUAGUGUAGAC (SEQ ID NO: 458) | 17 | downstream |
| CEP290-B69 | − | GUUGAGUAUCUCCUGUU (SEQ ID NO: 459) | 17 | downstream |
| CEP290-B115 | + | GAUGCAGAACUAGUGUAGAC (SEQ ID NO: 460) | 20 | downstream |
| CEP290-B187 | + | GCUUGAACUCUGUGCCAAAC (SEQ ID NO: 461) | 20 | downstream |

Table 4B provides targeting domains for break-induced deletion of genomic sequence including the mutation at the LCA10 target position in the CEP290 gene selected according to the second tier parameters. The targeting domains are within 400 bp upstream of an Alu repeat or 700 bp downstream of the mutation, have good orthogonality, and do not start with G. It is contemplated herein that the targeting domain hybridizes to the target domain through complementary base pairing. Any of the targeting domains in the table can be used with a *S. pyogenes* Cas9 molecule that generates a double stranded break (Cas9 nuclease) or a single-stranded break (Cas9 nickase).

Table 4C provides targeting domains for break-induced deletion of genomic sequence including the mutation at the LCA10 target position in the CEP290 gene selected according to the third tier parameters. The targeting domains are within 400 bp upstream of an Alu repeat or 700 bp downstream of the mutation, and start with G. It is contemplated herein that the targeting domain hybridizes to the target domain through complementary base pairing. Any of the targeting domains in the table can be used with a *S. pyogenes* Cas9 molecule that generates a double stranded break (Cas9 nuclease) or a single-stranded break (Cas9 nickase).

TABLE 4B

| gRNA Name | DNA Strand | Targeting Domain | Target Site Length | Position relative to mutation |
|---|---|---|---|---|
| CEP290-B269 | − | AGCUACCGGUUACCUGA (SEQ ID NO: 618) | 17 | downstream |
| CEP290-B285 | + | UUUAAGGCGGGGAGUCACAU (SEQ ID NO: 619) | 20 | downstream |
| CEP290-B3 | − | AAAGCUACCGGUUACCUGAA (SEQ ID NO: 620) | 20 | downstream |
| CEP290-B207 | − | AAAAGCUACCGGUUACCUGA (SEQ ID NO: 621) | 20 | downstream |
| CEP290-B106 | − | CUCAUACCUAUCCCUAU (SEQ ID NO: 594) | 17 | downstream |
| CEP290-B55 | + | ACACUGCCAAUAGGGAU (SEQ ID NO: 595) | 17 | downstream |
| CEP290-B138 | − | UAUCUCAUACCUAUCCCUAU (SEQ ID NO: 599) | 20 | downstream |
| CEP290-B62 | − | ACGUGCUCUUUUCUAUAUAU (SEQ ID NO: 622) | 20 | downstream |
| CEP290-B121 | + | AUUUGACACCACAUGCACUG (SEQ ID NO: 623) | 20 | downstream |
| CEP290-B120 | − | CGUGCUCUUUUCUAUAUAUA (SEQ ID NO: 624) | 20 | downstream |
| CEP290-B36 | − | UGGUGUCAAAUAUGGUGCUU (SEQ ID NO: 625) | 20 | downstream |
| CEP290-B236 | + | ACUUUUACCCUUCAGGUAAC (SEQ ID NO: 626) | 20 | downstream |
| CEP290-B70 | − | AGUGCAUGUGGUGUCAAAUA (SEQ ID NO: 627) | 20 | downstream |
| CEP290-B177 | − | UACAUGAGAGUGAUUAGUGG (SEQ ID NO: 628) | 20 | downstream |
| CEP290-B451 | − | CGUUGUUCUGAGUAGCUUUC (SEQ ID NO: 629) | 20 | upstream |
| CEP290-B452 | + | CCACAAGAUGUCUCUUGCCU (SEQ ID NO: 630) | 20 | upstream |
| CEP290-B453 | − | CCUAGGCAAGAGACAUCUUG (SEQ ID NO: 631) | 20 | upstream |
| CEP290-B454 | + | UGCCUAGGACUUUCUAAUGC (SEQ ID NO: 632) | 20 | upstream |
| CEP290-B498 | − | CGUUGUUCUGAGUAGCUUUC (SEQ ID NO: 629) | 20 | upstream |
| CEP290-B523 | − | AUUAGCUCAAAAGCUUUUGC (SEQ ID NO: 633) | 20 | upstream |

TABLE 4C

| gRNA Name | DNA Strand | Targeting Domain | Target Site Length | Position relative to mutation |
|---|---|---|---|---|
| CEP290-B87 | - | GCAUGUGGUGUCAAAUA (SEQ ID NO: 479) | 17 | downstream |
| CEP290-B50 | + | GAUGACAUGAGGUAAGU (SEQ ID NO: 478) | 17 | downstream |
| CEP290-B260 | + | GUCACAUGGGAGUCACA (SEQ ID NO: 500) | 17 | downstream |
| CEP290-B283 | - | GAGAGCCACAGUGCAUG (SEQ ID NO: 472) | 17 | downstream |
| CEP290-B85 | - | GCUCUUUUCUAUAUAUA (SEQ ID NO: 481) | 17 | downstream |
| CEP290-B78 | + | GCUUUUGACAGUUUUUA (SEQ ID NO: 634) | 17 | downstream |
| CEP290-B292 | + | GAUAGAGACAGGAAUAA (SEQ ID NO: 476) | 17 | downstream |
| CEP290-B278 | + | GGACUUGACUUUUACCCUUC (SEQ ID NO: 485) | 20 | downstream |
| CEP290-B227 | + | GGGAGUCACAUGGGAGUCAC (SEQ ID NO: 491) | 20 | downstream |
| CEP290-B261 | - | GUGGAGAGCCACAGUGCAUG (SEQ ID NO: 501) | 20 | downstream |
| CEP290-B182 | + | GCCUGAACAAGUUUUGAAAC (SEQ ID NO: 480) | 20 | downstream |
| CEP290-B67 | + | GGAGUCACAUGGGAGUCACA (SEQ ID NO: 487) | 20 | downstream |
| CEP290-B216 | + | GUAAGACUGGAGAUAGAGAC (SEQ ID NO: 497) | 20 | downstream |
| CEP290-B241 | + | GCUUUUGACAGUUUUUAAGG (SEQ ID NO: 482) | 20 | downstream |
| CEP290-B161 | + | GUUUAGAAUGAUCAUUCUUG (SEQ ID NO: 504) | 20 | downstream |
| CEP290-B259 | + | GUAGCUUUUGACAGUUUUUA (SEQ ID NO: 499) | 20 | downstream |
| CEP290-B79 | + | GGAGAUAGAGACAGGAAUAA (SEQ ID NO: 635) | 20 | downstream |
| CEP290-B436 | + | GUUCUGUCCUCAGUAAA (SEQ ID NO: 503) | 17 | upstream |
| CEP290-B444 | + | GGAUAGGACAGAGGACA (SEQ ID NO: 488) | 17 | upstream |
| CEP290-B445 | + | GAUGAAAAAUACUCUUU (SEQ ID NO: 477) | 17 | upstream |
| CEP290-B459 | - | GAACUCUAUACCUUUUACUG (SEQ ID NO: 466) | 20 | upstream |
| CEP290-B465 | + | GUAACAUAAUCACCUCUCUU (SEQ ID NO: 496) | 20 | upstream |
| CEP290-B473 | + | GAAAGAUGAAAAAUACUCUU (SEQ ID NO: 462) | 20 | upstream |
| CEP290-B528 | + | GUAACAUAAUCACCUCUCUU (SEQ ID NO: 496) | 20 | upstream |

Table 4D provides targeting domains for break-induced deletion of genomic sequence including the mutation at the LCA10 target position in the CEP290 gene selected according to the fourth tier parameters. The targeting domains are within 400 bp upstream of an Alu repeat or 700 bp downstream of the mutation, and do not start with G. It is contemplated herein that the targeting domain hybridizes to the target domain through complementary base pairing. Any of the targeting domains in the table can be used with a *S. pyogenes* Cas9 molecule that generates a double stranded break (Cas9 nuclease) or a single-stranded break (Cas9 nickase).

TABLE 4D

| gRNA Name | DNA Strand | Targeting Domain | Target Site Length | |
|---|---|---|---|---|
| CEP290-B233 | + | AAGGCGGGGAGUCACAU (SEQ ID NO: 636) | 17 | downstream |
| CEP290-B175 | + | UAAGGCGGGGAGUCACA (SEQ ID NO: 637) | 17 | downstream |
| CEP290-B280 | + | UGAACUCUGUGCCAAAC (SEQ ID NO: 638) | 17 | downstream |
| CEP290-B92 | + | CUAAGACACUGCCAAUA (SEQ ID NO: 597) | 17 | downstream |
| CEP290-B268 | + | UUUACCCUUCAGGUAAC (SEQ ID NO: 639) | 17 | downstream |
| CEP290-B154 | + | UGACACCACAUGCACUG (SEQ ID NO: 640) | 17 | downstream |
| CEP290-B44 | + | ACUAAGACACUGCCAAU (SEQ ID NO: 603) | 17 | downstream |
| CEP290-B231 | + | UUGCUCUAGAUGACAUG (SEQ ID NO: 641) | 17 | downstream |
| CEP290-B242 | + | UGACAGUUUUUAAGGCG (SEQ ID NO: 642) | 17 | downstream |
| CEP290-B226 | − | UGUCAAAUAUGGUGCUU (SEQ ID NO: 643) | 17 | downstream |
| CEP290-B159 | + | AGUCACAUGGGAGUCAC (SEQ ID NO: 644) | 17 | downstream |
| CEP290-B222 | − | AUGAGAGUGAUUAGUGG (SEQ ID NO: 645) | 17 | downstream |
| CEP290-B274 | + | UGACAUGAGGUAAGUAG (SEQ ID NO: 646) | 17 | downstream |
| CEP290-B68 | − | UACAUGAGAGUGAUUAG (SEQ ID NO: 647) | 17 | downstream |
| CEP290-B212 | + | UAAGGAGGAUGUAAGAC (SEQ ID NO: 648) | 17 | downstream |
| CEP290-B270 | + | CUUGACUUUUACCCUUC (SEQ ID NO: 649) | 17 | downstream |
| CEP290-B96 | + | UCACUGAGCAAAACAAC (SEQ ID NO: 650) | 17 | downstream |
| CEP290-B104 | + | AGACUUAUAUUCCAUUA (SEQ ID NO: 651) | 17 | downstream |
| CEP290-B122 | + | CAUGGGAGUCACAGGGU (SEQ ID NO: 652) | 17 | downstream |
| CEP290-B229 | + | UAGAAUGAUCAUUCUUG (SEQ ID NO: 653) | 17 | downstream |
| CEP290-B99 | + | UUGACAGUUUUUAAGGC (SEQ ID NO: 654) | 17 | downstream |
| CEP290-B7 | − | AAACUGUCAAAAGCUAC (SEQ ID NO: 655) | 17 | downstream |
| CEP290-B41 | + | UCAUUCUUGUGGCAGUA (SEQ ID NO: 2780) | 17 | downstream |

TABLE 4D-continued

| gRNA Name | DNA Strand | Targeting Domain | Target Site Length | |
|---|---|---|---|---|
| CEP290-B37 | + | AUGACAUGAGGUAAGUA (SEQ ID NO: 656) | 17 | downstream |
| CEP290-B97 | − | UGUUUCAAAACUUGUUC (SEQ ID NO: 657) | 17 | downstream |
| CEP290-B173 | − | AUAUCUGUCUUCCUUAA (SEQ ID NO: 658) | 17 | downstream |
| CEP290-B136 | + | UGAACAAGUUUUGAAAC (SEQ ID NO: 659) | 17 | downstream |
| CEP290-B71 | − | UUCUGCAUCUUAUACAU (SEQ ID NO: 660) | 17 | downstream |
| CEP290-B172 | − | AUAAGUCUUUUGAUAUA (SEQ ID NO: 661) | 17 | downstream |
| CEP290-B238 | + | UUUGACAGUUUUUAAGG (SEQ ID NO: 662) | 17 | downstream |
| CEP290-B148 | − | UGCUCUUUCUAUAUAU (SEQ ID NO: 663) | 17 | downstream |
| CEP290-B208 | + | AGACUGGAGAUAGAGAC (SEQ ID NO: 664) | 17 | downstream |
| CEP290-B53 | + | CAUAAGAAAGAACACUG (SEQ ID NO: 665) | 17 | downstream |
| CEP290-B166 | + | UUCUUGUGGCAGUAAGG (SEQ ID NO: 666) | 17 | downstream |
| CEP290-B247 | − | AAGCAUACUUUUUUUAA (SEQ ID NO: 667) | 17 | downstream |
| CEP290-B245 | + | CAACUGGAAGAGAGAAA (SEQ ID NO: 668) | 17 | downstream |
| CEP290-B167 | + | UAUGCUUAAGAAAAAAA (SEQ ID NO: 669) | 17 | downstream |
| CEP290-B171 | − | UUUUAUUAUCUUUAUUG (SEQ ID NO: 670) | 17 | downstream |
| CEP290-B140 | + | CUAGAUGACAUGAGGUAAGU (SEQ ID NO: 671) | 20 | downstream |
| CEP290-B147 | + | UUUUAAGGCGGGGAGUCACA (SEQ ID NO: 672) | 20 | downstream |
| CEP290-B253 | + | AAGACACUGCCAAUAGGGAU (SEQ ID NO: 600) | 20 | downstream |
| CEP290-B73 | − | UCCUGUUUCAAAACUUGUUC (SEQ ID NO: 673) | 20 | downstream |
| CEP290-B206 | − | UGUGUUGAGUAUCUCCUGUU (SEQ ID NO: 674) | 20 | downstream |
| CEP290-B57 | + | CUCUUGCUCUAGAUGACAUG (SEQ ID NO: 675) | 20 | downstream |
| CEP290-B82 | + | CAGUAAGGAGGAUGUAAGAC (SEQ ID NO: 676) | 20 | downstream |
| CEP290-B265 | + | AGAUGACAUGAGGUAAGUAG (SEQ ID NO: 677) | 20 | downstream |
| CEP290-B105 | + | AAUUCACUGAGCAAAACAAC (SEQ ID NO: 678) | 20 | downstream |
| CEP290-B239 | + | UCACAUGGGAGUCACAGGGU (SEQ ID NO: 679) | 20 | downstream |

TABLE 4D-continued

| gRNA Name | DNA Strand | Targeting Domain | Target Site Length | |
|---|---|---|---|---|
| CEP290-B180 | + | UAGAUGACAUGAGGUAAGUA (SEQ ID NO: 680) | 20 | downstream |
| CEP290-B103 | + | UUUUGACAGUUUUUAAGGCG (SEQ ID NO: 681) | 20 | downstream |
| CEP290-B254 | − | UAAUACAUGAGAGUGAUUAG (SEQ ID NO: 682) | 20 | downstream |
| CEP290-B134 | − | UAGUUCUGCAUCUUAUACAU (SEQ ID NO: 683) | 20 | downstream |
| CEP290-B151 | + | AAACUAAGACACUGCCAAUA (SEQ ID NO: 609) | 20 | downstream |
| CEP290-B196 | + | AAAACUAAGACACUGCCAAU (SEQ ID NO: 610) | 20 | downstream |
| CEP290-B2 | − | UAAAAACUGUCAAAAGCUAC (SEQ ID NO: 506) | 20 | downstream |
| CEP290-B240 | + | CUUUUGACAGUUUUUAAGGC (SEQ ID NO: 684) | 20 | downstream |
| CEP290-B116 | + | AAAAGACUUAUAUUCCAUUA (SEQ ID NO: 685) | 20 | downstream |
| CEP290-B39 | + | AUACAUAAGAAAGAACACUG (SEQ ID NO: 686) | 20 | downstream |
| CEP290-B91 | − | AAUAUAAGUCUUUUGAUAUA (SEQ ID NO: 687) | 20 | downstream |
| CEP290-B126 | + | UGAUCAUUCUUGUGGCAGUA (SEQ ID NO: 688) | 20 | downstream |
| CEP290-B202 | − | UACAUAUCUGUCUUCCUUAA (SEQ ID NO: 689) | 20 | downstream |
| CEP290-B152 | − | CUUAAGCAUACUUUUUUUAA (SEQ ID NO: 690) | 20 | downstream |
| CEP290-B77 | + | AAACAACUGGAAGAGAGAAA (SEQ ID NO: 691) | 20 | downstream |
| CEP290-B145 | + | UCAUUCUUGUGGCAGUAAGG (SEQ ID NO: 692) | 20 | downstream |
| CEP290-B72 | + | AAGUAUGCUUAAGAAAAAAA (SEQ ID NO: 693) | 20 | downstream |
| CEP290-B221 | − | AUUUUUAUUAUCUUUAUUG (SEQ ID NO: 694) | 20 | downstream |
| CEP290-B424 | + | CUAGGACUUUCUAAUGC (SEQ ID NO: 695) | 17 | upstream |
| CEP290-B425 | − | AUCUAAGAUCCUUUCAC (SEQ ID NO: 696) | 17 | upstream |
| CEP290-B426 | + | UUAUCACCACACUAAAU (SEQ ID NO: 697) | 17 | upstream |
| CEP290-B427 | − | AGCUCAAAAGCUUUUGC (SEQ ID NO: 698) | 17 | upstream |
| CEP290-B428 | − | UGUUCUGAGUAGCUUUC (SEQ ID NO: 699) | 17 | upstream |
| CEP290-B429 | + | ACUUUCUAAUGCUGGAG (SEQ ID NO: 700) | 17 | upstream |

TABLE 4D-continued

| gRNA Name | DNA Strand | Targeting Domain | Target Site Length | |
|---|---|---|---|---|
| CEP290-B430 | − | CUCUAUACCUUUUACUG (SEQ ID NO: 701) | 17 | upstream |
| CEP290-B431 | + | CAAGAUGUCUCUUGCCU (SEQ ID NO: 702) | 17 | upstream |
| CEP290-B432 | − | AUUAUGCCUAUUUAGUG (SEQ ID NO: 703) | 17 | upstream |
| CEP290-B433 | + | AUGACUCAUAAUUUAGU (SEQ ID NO: 704) | 17 | upstream |
| CEP290-B434 | − | UAGAGGCUUAUGGAUUU (SEQ ID NO: 705) | 17 | upstream |
| CEP290-B435 | + | UAUUCUACUCCUGUGAA (SEQ ID NO: 706) | 17 | upstream |
| CEP290-B437 | + | CUAAUGCUGGAGAGGAU (SEQ ID NO: 707) | 17 | upstream |
| CEP290-B438 | − | AGGCAAGAGACAUCUUG (SEQ ID NO: 708) | 17 | upstream |
| CEP290-B439 | + | AGCCUCUAUUUCUGAUG (SEQ ID NO: 709) | 17 | upstream |
| CEP290-B440 | − | CAGCAUUAGAAAGUCCU (SEQ ID NO: 710) | 17 | upstream |
| CEP290-B441 | − | CUGCUUUUGCCAAAGAG (SEQ ID NO: 711) | 17 | upstream |
| CEP290-B442 | + | ACAUAAUCACCUCUCUU (SEQ ID NO: 712) | 17 | upstream |
| CEP290-B443 | − | UCAGAAAUAGAGGCUUA (SEQ ID NO: 713) | 17 | upstream |
| CEP290-B446 | − | UUCCUCAUCAGAAAUAG (SEQ ID NO: 714) | 17 | upstream |
| CEP290-B447 | + | ACAGAGGACAUGGAGAA (SEQ ID NO: 715) | 17 | upstream |
| CEP290-B448 | + | UGGAGAGGAUAGGACAG (SEQ ID NO: 716) | 17 | upstream |
| CEP290-B449 | + | AGGAAGAUGAACAAAUC (SEQ ID NO: 717) | 17 | upstream |
| CEP290-B450 | + | AGAUGAAAAUACUCUU (SEQ ID NO: 718) | 17 | upstream |
| CEP290-B455 | + | AGGACUUUCUAAUGCUGGAG (SEQ ID NO: 719) | 20 | upstream |
| CEP290-B456 | − | AUUAGCUCAAAAGCUUUUGC (SEQ ID NO: 633) | 20 | upstream |
| CEP290-B457 | − | CUCCAGCAUUAGAAAGUCCU (SEQ ID NO: 720) | 20 | upstream |
| CEP290-B458 | + | AACAUGACUCAUAAUUUAGU (SEQ ID NO: 721) | 20 | upstream |
| CEP290-B460 | − | AUCUUCCUCAUCAGAAAUAG (SEQ ID NO: 722) | 20 | upstream |
| CEP290-B461 | + | AUAAGCCUCUAUUUCUGAUG (SEQ ID NO: 723) | 20 | upstream |
| CEP290-B462 | + | UCUUAUUCUACUCCUGUGAA (SEQ ID NO: 724) | 20 | upstream |

TABLE 4D-continued

| gRNA Name | DNA Strand | Targeting Domain | Target Site Length | |
|---|---|---|---|---|
| CEP290-B463 | − | CUGCUGCUUUUGCCAAAGAG (SEQ ID NO: 725) | 20 | upstream |
| CEP290-B464 | + | UUUCUAAUGCUGGAGAGGAU (SEQ ID NO: 726) | 20 | upstream |
| CEP290-B466 | + | AAAUUAUCACCACACUAAAU (SEQ ID NO: 727) | 20 | upstream |
| CEP290-B467 | + | CUUGUUCUGUCCUCAGUAAA (SEQ ID NO: 728) | 20 | upstream |
| CEP290-B468 | − | AAAAUUAUGCCUAUUUAGUG (SEQ ID NO: 729) | 20 | upstream |
| CEP290-B469 | − | UCAUCAGAAAUAGAGGCUUA (SEQ ID NO: 730) | 20 | upstream |
| CEP290-B470 | − | AAAUAGAGGCUUAUGGAUUU (SEQ ID NO: 731) | 20 | upstream |
| CEP290-B471 | + | UGCUGGAGAGGAUAGGACAG (SEQ ID NO: 732) | 20 | upstream |
| CEP290-B472 | + | AUGAGGAAGAUGAACAAAUC (SEQ ID NO: 733) | 20 | upstream |
| CEP290-B474 | − | CUUAUCUAAGAUCCUUUCAC (SEQ ID NO: 734) | 20 | upstream |
| CEP290-B475 | + | AGAGGAUAGGACAGAGGACA (SEQ ID NO: 735) | 20 | upstream |
| CEP290-B476 | + | AGGACAGAGGACAUGGAGAA (SEQ ID NO: 736) | 20 | upstream |
| CEP290-B477 | + | AAAGAUGAAAAAUACUCUUU (SEQ ID NO: 737) | 20 | upstream |
| CEP290-B495 | − | AGCUCAAAAGCUUUUGC (SEQ ID NO: 698) | 17 | upstream |
| CEP290-B529 | − | UGUUCUGAGUAGCUUUC (SEQ ID NO: 699) | 17 | upstream |
| CEP290-B513 | + | AUGACUCAUAAUUUAGU (SEQ ID NO: 704) | 17 | upstream |
| CEP290-B490 | + | UAUUCUACUCCUGUGAA (SEQ ID NO: 706) | 17 | upstream |
| CEP290-B485 | − | CUGCUUUUGCCAAAGAG (SEQ ID NO: 711) | 17 | upstream |
| CEP290-B492 | + | ACAUAAUCACCUCUCUU (SEQ ID NO: 712) | 17 | upstream |
| CEP290-B506 | + | AACAUGACUCAUAAUUUAGU (SEQ ID NO: 721) | 20 | upstream |
| CEP290-B500 | + | UCUUAUUCUACUCCUGUGAA (SEQ ID NO: 724) | 20 | upstream |
| CEP290-B521 | − | CUGCUGCUUUUGCCAAAGAG (SEQ ID NO: 725) | 20 | upstream |

Table 5A provides targeting domains for break-induced deletion of genomic sequence including the mutation at the LCA10 target position in the CEP290 gene selected according to the first tier parameters. The targeting domains are within 400 bp upstream of an Alu repeat or 700 bp downstream of the mutation, have good orthogonality, and start with G. It is contemplated herein that the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 5A

| gRNA Name | DNA Strand | Targeting Domain | Target Site Length | Position relative to mutation |
|---|---|---|---|---|
| CEP290-B1008 | + | GAAUCCUGAAAGCUACU (SEQ ID NO: 510) | 17 | upstream |

Table 5B provides targeting domains for break-induced deletion of genomic sequence including the mutation at the LCA10 target position in the CEP290 gene selected according to the second tier parameters. The targeting domains are within 400 bp upstream of an Alu repeat or 700 bp downstream of the mutation, have good orthogonality, and do not start with G. It is contemplated herein that the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 5B

| gRNA Name | DNA Strand | Targeting Domain | Target Site Length | Position relative to mutation |
|---|---|---|---|---|
| CEP290-B1009 | − | CCUACUUACCUCAUGUCAUC (SEQ ID NO: 747) | 20 | downstream |
| CEP290-B1010 | + | CUAUGAGCCAGCAAAAGCUU (SEQ ID NO: 748) | 20 | upstream |
| CEP290-B1011 | − | AC GUUGUUCUGAGUAGCUUU (SEQ ID NO: 749) | 20 | upstream |
| CEP290-B1012 | − | CAUAGAGACACAUUCAGUAA (SEQ ID NO: 750) | 20 | upstream |
| CEP290-B1013 | − | ACUUACCUCAUGUCAUC (SEQ ID NO: 751) | 17 | downstream |
| CEP290-B1014 | + | UGAGCCAGCAAAAGCUU (SEQ ID NO: 752) | 17 | upstream |
| CEP290-B1015 | − | UUGUUCUGAGUAGCUUU (SEQ ID NO: 753) | 17 | upstream |
| CEP290-B1016 | − | AGAGACACAUUCAGUAA (SEQ ID NO: 754) | 17 | upstream |
| CEP290-B1017 | + | UUUAAGGCGGGGAGUCACAU (SEQ ID NO: 619) | 20 | upstream |
| CEP290-B1018 | − | CAAAAGCUACCGGUUACCUG (SEQ ID NO: 755) | 20 | downstream |
| CEP290-B1019 | + | UUUUAAGGCGGGGAGUCACA (SEQ ID NO: 672) | 20 | downstream |
| CEP290-B1020 | − | UGUCAAAAGCUACCGGUUAC (SEQ ID NO: 757) | 20 | downstream |
| CEP290-B1021 | + | AAGGCGGGGAGUCACAU (SEQ ID NO: 636) | 17 | downstream |
| CEP290-B1022 | − | AAGCUACCGGUUACCUG (SEQ ID NO: 758) | 17 | downstream |
| CEP290-B1023 | + | UAAGGCGGGGAGUCACA (SEQ ID NO: 637) | 17 | downstream |
| CEP290-B1024 | − | CAAAAGCUACCGGUUAC (SEQ ID NO: 759) | 17 | downstream |
| CEP290-B1025 | + | UAGGAAUCCUGAAAGCUACU (SEQ ID NO: 760) | 20 | upstream |
| CEP290-B1026 | + | CAGAACAACGUUUUCAUUUA (SEQ ID NO: 761) | 20 | upstream |
| CEP290-B1027 | − | CAAAAGCUUUUGCUGGCUCA (SEQ ID NO: 762) | 20 | upstream |
| CEP290-B1028 | + | AGCAAAAGCUUUUGAGCUAA (SEQ ID NO: 763) | 20 | upstream |

TABLE 5B-continued

| gRNA Name | DNA Strand | Targeting Domain | Target Site Length | Position relative to mutation |
|---|---|---|---|---|
| CEP290-B1029 | + | AUCUUAUUCUACUCCUGUGA (SEQ ID NO: 764) | 20 | upstream |
| CEP290-B1030 | + | AACAACGUUUUCAUUUA (SEQ ID NO: 765) | 17 | upstream |
| CEP290-B1031 | − | AAGCUUUUGCUGGCUCA (SEQ ID NO: 766) | 17 | upstream |
| CEP290-B1032 | + | AAAAGCUUUUGAGCUAA (SEQ ID NO: 767) | 17 | upstream |
| CEP290-B1033 | + | UUAUUCUACUCCUGUGA (SEQ ID NO: 768) | 17 | upstream |

Table 5C provides targeting domains for break-induced deletion of genomic sequence including the mutation at the LCA10 target position in the CEP290 gene selected according to the third tier parameters. The targeting domains are within 400 bp upstream of an Alu repeat or 700 bp downstream of the mutation, and start with G. It is contemplated herein that the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 5C

| gRNA Name | DNA Strand | Targeting Domain | Target Site Length | Position relative to mutation |
|---|---|---|---|---|
| CEP290-B1034 | + | GAAACAGGAAUAGAAAUUCA (SEQ ID NO: 769) | 20 | downstream |
| CEP290-B1035 | + | GAAAGAUGAAAAAUACUCUU (SEQ ID NO: 462) | 20 | upstream |
| CEP290-B1036 | − | GAAAUAGAGGCUUAUGGAUU (SEQ ID NO: 547) | 20 | upstream |
| CEP290-B1037 | − | GAAUAUAAGUCUUUUGAUAU (SEQ ID NO: 770) | 20 | downstream |
| CEP290-B1038 | + | GAGAAAUGGUUCCCUAUAUA (SEQ ID NO: 771) | 20 | downstream |
| CEP290-B1039 | + | GAGAGGAUAGGACAGAGGAC (SEQ ID NO: 772) | 20 | upstream |
| CEP290-B1040 | + | GAUGAGGAAGAUGAACAAAU (SEQ ID NO: 773) | 20 | upstream |
| CEP290-B1041 | + | GAUGCAGAACUAGUGUAGAC (SEQ ID NO: 460) | 20 | downstream |
| CEP290-B1042 | − | GAUUUGUUCAUCUUCCUCAU (SEQ ID NO: 774) | 20 | upstream |
| CEP290-B1043 | + | GCAGUAAGGAGGAUGUAAGA (SEQ ID NO: 775) | 20 | downstream |
| CEP290-B1044 | + | GCCUGAACAAGUUUUGAAAC (SEQ ID NO: 480) | 20 | downstream |
| CEP290-B1045 | + | GCUUGAACUCUGUGCCAAAC (SEQ ID NO: 461) | 20 | downstream |
| CEP290-B1046 | − | GCUUUCUGCUGCUUUUGCCA (SEQ ID NO: 776) | 20 | upstream |
| CEP290-B1047 | − | GCUUUCUGCUGCUUUUGCCA (SEQ ID NO: 776) | 20 | upstream |

TABLE 5C-continued

| gRNA Name | DNA Strand | Targeting Domain | Target Site Length | Position relative to mutation |
|---|---|---|---|---|
| CEP290-B1048 | + | GCUUUUGACAGUUUUUAAGG (SEQ ID NO: 482) | 20 | downstream |
| CEP290-B1049 | + | GGAAAGAUGAAAAAUACUCU (SEQ ID NO: 778) | 20 | upstream |
| CEP290-B1050 | + | GGAGGAUGUAAGACUGGAGA (SEQ ID NO: 779) | 20 | downstream |
| CEP290-B1051 | + | GGGGAGUCACAUGGGAGUCA (SEQ ID NO: 573) | 20 | downstream |
| CEP290-B1052 | - | GGUGAUUAUGUUACUUUUUA (SEQ ID NO: 780) | 20 | upstream |
| CEP290-B1053 | - | GGUGAUUAUGUUACUUUUUA (SEQ ID NO: 780) | 20 | upstream |
| CEP290-B1054 | + | GUAAGACUGGAGAUAGAGAC (SEQ ID NO: 497) | 20 | downstream |
| CEP290-B1055 | + | GUCACAUGGGAGUCACAGGG (SEQ ID NO: 586) | 20 | downstream |
| CEP290-B1056 | - | GUGGUGUCAAAUAUGGUGCU (SEQ ID NO: 782) | 20 | downstream |
| CEP290-B1057 | + | GAAAAAAAGGUAAUGC (SEQ ID NO: 783) | 17 | downstream |
| CEP290-B1058 | + | GAAAAGAGCACGUACAA (SEQ ID NO: 784 | 17 | downstream |
| CEP290-B1059 | + | GAAUCCUGAAAGCUACU (SEQ ID NO: 510) | 17 | upstream |
| CEP290-B1060 | - | GAAUGAUCAUUCUAAAC (SEQ ID NO: 785) | 17 | downstream |
| CEP290-B1061 | + | GACAGAGGACAUGGAGA (SEQ ID NO: 786) | 17 | upstream |
| CEP290-B1062 | + | GACUUUCUAAUGCUGGA (SEQ ID NO: 787) | 17 | upstream |
| CEP290-B1063 | - | GAGAGUGAUUAGUGGUG (SEQ ID NO: 788) | 17 | downstream |
| CEP290-B1064 | + | GAGCAAACAACUGGAA (SEQ ID NO: 789) | 17 | downstream |
| CEP290-B1065 | + | GAGGAAGAUGAACAAAU (SEQ ID NO: 790) | 17 | upstream |
| CEP290-B1066 | + | GAGUCACAUGGGAGUCA (SEQ ID NO: 791) | 17 | downstream |
| CEP290-B1067 | + | GAUCUUAUUCUACUCCU (SEQ ID NO: 792) | 17 | upstream |
| CEP290-B1068 | + | GAUCUUAUUCUACUCCU (SEQ ID NO: 792) | 17 | upstream |
| CEP290-B1069 | + | GAUGAAAAAUACUCUUU (SEQ ID NO: 477) | 17 | upstream |
| CEP290-B1070 | + | GAUGACAUGAGGUAAGU (SEQ ID NO: 478) | 17 | downstream |
| CEP290-B1071 | - | GAUUAUGUUACUUUUUA (SEQ ID NO: 793) | 17 | upstream |
| CEP290-B1072 | - | GAUUAUGUUACUUUUUA (SEQ ID NO: 793) | 17 | upstream |

TABLE 5C-continued

| gRNA Name | DNA Strand | Targeting Domain | Target Site Length | Position relative to mutation |
|---|---|---|---|---|
| CEP290-B1073 | + | GCAAAACAACUGGAAGA (SEQ ID NO: 794) | 17 | downstream |
| CEP290-B1074 | + | GCAGAACUAGUGUAGAC (SEQ ID NO: 458) | 17 | downstream |
| CEP290-B1075 | − | GCUCUUUUCUAUAUAUA (SEQ ID NO: 481) | 17 | downstream |
| CEP290-B1076 | + | GGAUAGGACAGAGGACA (SEQ ID NO: 488) | 17 | upstream |
| CEP290-B1077 | + | GGAUGUAAGACUGGAGA (SEQ ID NO: 795) | 17 | downstream |
| CEP290-B1078 | + | GUAAGGAGGAUGUAAGA (SEQ ID NO: 796) | 17 | downstream |
| CEP290-B1079 | − | GUAUCUCCUGUUUGGCA (SEQ ID NO: 797) | 17 | downstream |
| CEP290-B1080 | − | GUCAUCUAGAGCAAGAG (SEQ ID NO: 798) | 17 | downstream |
| CEP290-B1081 | + | GUCCUCAGUAAAAGGUA (SEQ ID NO: 799) | 17 | upstream |
| CEP290-B1082 | + | GUGAAAGGAUCUUAGAU (SEQ ID NO: 800) | 17 | upstream |
| CEP290-B1083 | − | GUGCUCUUUUCUAUAUA (SEQ ID NO: 801) | 17 | downstream |
| CEP290-B1084 | − | GUGUCAAAUAUGGUGCU (SEQ ID NO: 802) | 17 | downstream |
| CEP290-B1085 | + | GUUCCCUAUAUAUAGAA (SEQ ID NO: 803) | 17 | downstream |

Table 5D provides targeting domains for break-induced deletion of genomic sequence including the mutation at the LCA10 target position in the CEP290 gene selected according to the fourth tier parameters. The targeting domains are within 400 bp upstream of an Alu repeat or 700 bp downstream of the mutation, and do not start with G. It is contemplated herein that the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 5D

| gRNA Name | DNA Strand | Targeting Domain | Target Site Length | Position relative to mutation |
|---|---|---|---|---|
| CEP290-B1086 | + | AAAACUAAGACACUGCCAAU (SEQ ID NO: 610) | 20 | downstream |
| CEP290-B1087 | + | AAAAGACUUAUAUUCCAUUA (SEQ ID NO: 685) | 20 | downstream |
| CEP290-B1088 | + | AAACAUGACUCAUAAUUUAG (SEQ ID NO: 805) | 20 | upstream |
| CEP290-B1089 | + | AAACAUGACUCAUAAUUUAG (SEQ ID NO: 805) | 20 | upstream |
| CEP290-B1090 | + | AAAGAUGAAAAAUACUCUUU (SEQ ID NO: 737) | 20 | upstream |
| CEP290-B1091 | + | AAAUUCACUGAGCAAAACAA (SEQ ID NO: 808) | 20 | downstream |
| CEP290-B1092 | + | AACAAGUUUUGAAACAGGAA (SEQ ID NO: 809) | 20 | downstream |

TABLE 5D-continued

| gRNA Name | DNA Strand | Targeting Domain | Target Site Length | Position relative to mutation |
|---|---|---|---|---|
| CEP290-B1093 | + | AACAGGAGAUACUCAACACA (SEQ ID NO: 810) | 20 | downstream |
| CEP290-B1094 | + | AACAUGACUCAUAAUUUAGU (SEQ ID NO: 721) | 20 | upstream |
| CEP290-B1095 | + | AACAUGACUCAUAAUUUAGU (SEQ ID NO: 721) | 20 | upstream |
| CEP290-B1096 | − | AAUAUAAGUCUUUUGAUAUA (SEQ ID NO: 687) | 20 | downstream |
| CEP290-B1097 | + | AAUCACUCUCAUGUAUUAGC (SEQ ID NO: 814) | 20 | downstream |
| CEP290-B1098 | + | AAUUCACUGAGCAAAACAAC (SEQ ID NO: 678) | 20 | downstream |
| CEP290-B1099 | + | ACAAAAGAACAUACAUAAGA (SEQ ID NO: 816) | 20 | downstream |
| CEP290-B1100 | + | ACGUACAAAAGAACAUACAU (SEQ ID NO: 817) | 20 | downstream |
| CEP290-B1101 | − | ACGUGCUCUUUUCUAUAUAU (SEQ ID NO: 622) | 20 | downstream |
| CEP290-B1102 | − | AC GUUGUUCUGAGUAGCUUU (SEQ ID NO: 749) | 20 | upstream |
| CEP290-B1103 | + | ACUGAGCAAAACAACUGGAA (SEQ ID NO: 819) | 20 | downstream |
| CEP290-B1104 | + | AGAGGAUAGGACAGAGGACA (SEQ ID NO: 735) | 20 | upstream |
| CEP290-B1105 | + | AGAUGCAGAACUAGUGUAGA (SEQ ID NO: 821) | 20 | downstream |
| CEP290-B1106 | + | AGCAAAAGCUUUUGAGCUAA (SEQ ID NO: 763) | 20 | upstream |
| CEP290-B1107 | − | AGCAUUAGAAAGUCCUAGGC (SEQ ID NO: 823) | 20 | upstream |
| CEP290-B1108 | + | AGCUUGAACUCUGUGCCAAA (SEQ ID NO: 824) | 20 | downstream |
| CEP290-B1109 | + | AGCUUUUGACAGUUUUUAAG (SEQ ID NO: 825) | 20 | downstream |
| CEP290-B1110 | + | AGGACAGAGGACAUGGAGAA (SEQ ID NO: 736) | 20 | upstream |
| CEP290-B1111 | + | AGGAUAGGACAGAGGACAUG (SEQ ID NO: 827) | 20 | upstream |
| CEP290-B1112 | + | AGGUAAUGCCUGAACAAGUU (SEQ ID NO: 828) | 20 | downstream |
| CEP290-B1113 | + | AUAAGAAAGAACACUGUGGU (SEQ ID NO: 829) | 20 | downstream |
| CEP290-B1114 | + | AUAAGCCUCUAUUUCUGAUG (SEQ ID NO: 723) | 20 | upstream |
| CEP290-B1115 | − | AUACAUGAGAGUGAUUAGUG (SEQ ID NO: 831) | 20 | downstream |
| CEP290-B1116 | + | AUAGAAAAGAGCACGUACAA (SEQ ID NO: 832) | 20 | downstream |
| CEP290-B1117 | + | AUCAUUCUUGUGGCAGUAAG (SEQ ID NO: 833) | 20 | downstream |

TABLE 5D-continued

| gRNA Name | DNA Strand | Targeting Domain | Target Site Length | Position relative to mutation |
|---|---|---|---|---|
| CEP290-B1118 | + | AUCUUAUUCUACUCCUGUGA (SEQ ID NO: 764) | 20 | upstream |
| CEP290-B1119 | − | AUCUUGUGGAUAAUGUAUCA (SEQ ID NO: 835) | 20 | upstream |
| CEP290-B1120 | + | AUGAGGAAGAUGAACAAAUC (SEQ ID NO: 733) | 20 | upstream |
| CEP290-B1121 | + | AUGAUCAUUCUUGUGGCAGU (SEQ ID NO: 837) | 20 | downstream |
| CEP290-B1122 | + | AUGCUGGAGAGGAUAGGACA (SEQ ID NO: 838) | 20 | upstream |
| CEP290-B1123 | + | AUGGUUCCCUAUAUAUAGAA (SEQ ID NO: 839) | 20 | downstream |
| CEP290-B1124 | − | AUUUAAUUUGUUUCUGUGUG (SEQ ID NO: 840) | 20 | downstream |
| CEP290-B1125 | + | CAAAACCUAUGUAUAAGAUG (SEQ ID NO: 841) | 20 | downstream |
| CEP290-B1126 | + | CAAAAGACUUAUAUUCCAUU (SEQ ID NO: 842) | 20 | downstream |
| CEP290-B1127 | − | CAAAAGCUUUUGCUGGCUCA (SEQ ID NO: 762) | 20 | upstream |
| CEP290-B1128 | − | CAAGAAUGAUCAUUCUAAAC (SEQ ID NO: 844) | 20 | downstream |
| CEP290-B1129 | − | CACAGAGUUCAAGCUAAUAC (SEQ ID NO: 845) | 20 | downstream |
| CEP290-B1130 | + | CACAGGGUAGGAUUCAUGUU (SEQ ID NO: 846) | 20 | downstream |
| CEP290-B1131 | + | CACUGCCAAUAGGGAUAGGU (SEQ ID NO: 613) | 20 | downstream |
| CEP290-B1132 | + | CAGAACAACGUUUUCAUUUA (SEQ ID NO: 761) | 20 | upstream |
| CEP290-B1133 | − | CAGAGUUCAAGCUAAUACAU (SEQ ID NO: 848) | 20 | downstream |
| CEP290-B1134 | − | CAGUAAAUGAAAACGUUGUU (SEQ ID NO: 849) | 20 | upstream |
| CEP290-B1135 | − | CAGUAAAUGAAAACGUUGUU (SEQ ID NO: 849) | 20 | upstream |
| CEP290-B1136 | + | CAGUAAGGAGGAUGUAAGAC (SEQ ID NO: 676) | 20 | downstream |
| CEP290-B1137 | + | CAUAAGCCUCUAUUUCUGAU (SEQ ID NO: 851) | 20 | upstream |
| CEP290-B1138 | − | CAUAGAGACACAUUCAGUAA (SEQ ID NO: 750) | 20 | upstream |
| CEP290-B1139 | + | CAUCUCUUGCUCUAGAUGAC (SEQ ID NO: 853) | 20 | downstream |
| CEP290-B1140 | − | CAUGAGAGUGAUUAGUGGUG (SEQ ID NO: 854) | 20 | downstream |
| CEP290-B1141 | − | CAUGUCAUCUAGAGCAAGAG (SEQ ID NO: 855) | 20 | downstream |
| CEP290-B1142 | + | CAUUUACUGAAUGUGUCUCU (SEQ ID NO: 856) | 20 | upstream |

TABLE 5D-continued

| gRNA Name | DNA Strand | Targeting Domain | Target Site Length | Position relative to mutation |
|---|---|---|---|---|
| CEP290-B1143 | + | CAUUUACUGAAUGUGUCUCU (SEQ ID NO: 856) | 20 | upstream |
| CEP290-B1144 | + | CCAUUAAAAAAAGUAUGCUU (SEQ ID NO: 857) | 20 | downstream |
| CEP290-B1145 | + | CCUAGGACUUUCUAAUGCUG (SEQ ID NO: 858) | 20 | upstream |
| CEP290-B1146 | + | CCUCUCUUUGGCAAAAGCAG (SEQ ID NO: 859) | 20 | upstream |
| CEP290-B1147 | + | CCUCUCUUUGGCAAAAGCAG (SEQ ID NO: 859) | 20 | upstream |
| CEP290-B1148 | + | CCUGUGAAAGGAUCUUAGAU (SEQ ID NO: 860) | 20 | upstream |
| CEP290-B1149 | − | CGUGCUCUUUUCUAUAUAUA (SEQ ID NO: 624) | 20 | downstream |
| CEP290-B1150 | − | CUAAGAUCCUUUCACAGGAG (SEQ ID NO: 861) | 20 | upstream |
| CEP290-B1151 | + | CUAGAUGACAUGAGGUAAGU (SEQ ID NO: 671) | 20 | downstream |
| CEP290-B1152 | + | CUAUGAGCCAGCAAAAGCUU (SEQ ID NO: 748) | 20 | upstream |
| CEP290-B1153 | + | CUCAUAAUUUAGUAGGAAUC (SEQ ID NO: 864) | 20 | upstream |
| CEP290-B1154 | + | CUCAUAAUUUAGUAGGAAUC (SEQ ID NO: 864) | 20 | upstream |
| CEP290-B1155 | − | CUCAUCAGAAAUAGAGGCUU (SEQ ID NO: 865) | 20 | upstream |
| CEP290-B1156 | + | CUCUAUUUCUGAUGAGGAAG (SEQ ID NO: 866) | 20 | upstream |
| CEP290-B1157 | − | CUUAAGCAUACUUUUUUUAA (SEQ ID NO: 690) | 20 | downstream |
| CEP290-B1158 | − | CUUAUCUAAGAUCCUUUCAC (SEQ ID NO: 734) | 20 | upstream |
| CEP290-B1159 | + | CUUUCUAAUGCUGGAGAGGA (SEQ ID NO: 869) | 20 | upstream |
| CEP290-B1160 | + | CUUUUGACAGUUUUUAAGGC (SEQ ID NO: 684) | 20 | downstream |
| CEP290-B1161 | + | UAAAACUAAGACACUGCCAA (SEQ ID NO: 871) | 20 | downstream |
| CEP290-B1162 | + | UAAGAAAAAAAAGGUAAUGC (SEQ ID NO: 872) | 20 | downstream |
| CEP290-B1163 | + | UAAUGCUGGAGAGGAUAGGA (SEQ ID NO: 873) | 20 | upstream |
| CEP290-B1164 | − | UACAUAUCUGUCUUCCUUAA (SEQ ID NO: 689) | 20 | downstream |
| CEP290-B1165 | − | UACAUCCUCCUUACUGCCAC (SEQ ID NO: 875) | 20 | downstream |
| CEP290-B1166 | − | UACAUGAGAGUGAUUAGUGG (SEQ ID NO: 628) | 20 | downstream |
| CEP290-B1167 | − | UACCUCAUGUCAUCUAGAGC (SEQ ID NO: 876) | 20 | downstream |

TABLE 5D-continued

| gRNA Name | DNA Strand | Targeting Domain | Target Site Length | Position relative to mutation |
|---|---|---|---|---|
| CEP290-B1168 | − | UACGUGCUCUUUUCUAUAUA (SEQ ID NO: 877) | 20 | downstream |
| CEP290-B1169 | − | UAGAGCAAGAGAUGAACUAG (SEQ ID NO: 878) | 20 | downstream |
| CEP290-B1170 | + | UAGAUGACAUGAGGUAAGUA (SEQ ID NO: 680) | 20 | downstream |
| CEP290-B1171 | + | UAGGAAUCCUGAAAGCUACU (SEQ ID NO: 760) | 20 | upstream |
| CEP290-B1172 | + | UAGGACAGAGGACAUGGAGA (SEQ ID NO: 881) | 20 | upstream |
| CEP290-B1173 | + | UAGGACUUUCUAAUGCUGGA (SEQ ID NO: 882) | 20 | upstream |
| CEP290-B1174 | + | UCACUGAGCAAAACAACUGG (SEQ ID NO: 883) | 20 | downstream |
| CEP290-B1175 | − | UCAUGUUUAUCAAUAUUAUU (SEQ ID NO: 884) | 20 | upstream |
| CEP290-B1176 | − | UCAUGUUUAUCAAUAUUAUU (SEQ ID NO: 884) | 20 | upstream |
| CEP290-B1177 | + | UCCACAAGAUGUCUCUUGCC (SEQ ID NO: 885) | 20 | upstream |
| CEP290-B1178 | + | UCCAUAAGCCUCUAUUUCUG (SEQ ID NO: 886) | 20 | upstream |
| CEP290-B1179 | − | UCCUAGGCAAGAGACAUCUU (SEQ ID NO: 887) | 20 | upstream |
| CEP290-B1180 | + | UCUAGAUGACAUGAGGUAAG (SEQ ID NO: 888) | 20 | downstream |
| CEP290-B1181 | − | UCUAUACCUUUUACUGAGGA (SEQ ID NO: 889) | 20 | upstream |
| CEP290-B1182 | + | UCUGUCCUCAGUAAAAGGUA (SEQ ID NO: 890) | 20 | upstream |
| CEP290-B1183 | − | UCUUAAGCAUACUUUUUUUA (SEQ ID NO: 891) | 20 | downstream |
| CEP290-B1184 | − | UCUUAUCUAAGAUCCUUUCA (SEQ ID NO: 892) | 20 | upstream |
| CEP290-B1185 | − | UCUUCCAGUUGUUUUGCUCA (SEQ ID NO: 893) | 20 | downstream |
| CEP290-B1186 | + | UGAGCAAAACAACUGGAAGA (SEQ ID NO: 894) | 20 | downstream |
| CEP290-B1187 | − | UGAGUAUCUCCUGUUUGGCA (SEQ ID NO: 895) | 20 | downstream |
| CEP290-B1188 | + | UGAUCAUUCUUGUGGCAGUA (SEQ ID NO: 688) | 20 | downstream |
| CEP290-B1189 | + | UGCCUAGGACUUUCUAAUGC (SEQ ID NO: 632) | 20 | upstream |
| CEP290-B1190 | + | UGCCUGAACAAGUUUUGAAA (SEQ ID NO: 897) | 20 | downstream |
| CEP290-B1191 | − | UGGUGUCAAAUAUGGUGCUU (SEQ ID NO: 625) | 20 | downstream |
| CEP290-B1192 | + | UGUAAGACUGGAGAUAGAGA (SEQ ID NO: 898) | 20 | downstream |

TABLE 5D-continued

| gRNA Name | DNA Strand | Targeting Domain | Target Site Length | Position relative to mutation |
|---|---|---|---|---|
| CEP290-B1193 | – | UGUCCUAUCCUCUCCAGCAU (SEQ ID NO: 899) | 20 | upstream |
| CEP290-B1194 | – | UUAACGUUAUCAUUUUCCCA (SEQ ID NO: 900) | 20 | upstream |
| CEP290-B1195 | – | UUACAUAUCUGUCUUCCUUA (SEQ ID NO: 901) | 20 | downstream |
| CEP290-B1196 | + | UUAGAUCUUAUUCUACUCCU (SEQ ID NO: 902) | 20 | upstream |
| CEP290-B1197 | + | UUAGAUCUUAUUCUACUCCU (SEQ ID NO: 902) | 20 | upstream |
| CEP290-B1198 | – | UUCAGGAUUCCUACUAAAUU (SEQ ID NO: 904) | 20 | upstream |
| CEP290-B1199 | – | UUCAGGAUUCCUACUAAAUU (SEQ ID NO: 904) | 20 | upstream |
| CEP290-B1200 | – | UUCAUCUUCCUCAUCAGAAA (SEQ ID NO: 905) | 20 | upstream |
| CEP290-B1201 | + | UUGCCUAGGACUUUCUAAUG (SEQ ID NO: 906) | 20 | upstream |
| CEP290-B1202 | – | UUUCUGCUGCUUUUGCCAAA (SEQ ID NO: 907) | 20 | upstream |
| CEP290-B1203 | – | UUUCUGCUGCUUUUGCCAAA (SEQ ID NO: 907) | 20 | upstream |
| CEP290-B1204 | + | UUUUGACAGUUUUUAAGGCG (SEQ ID NO: 681) | 20 | downstream |
| CEP290-B1205 | + | UUUUUAAGGCGGGGAGUCAC (SEQ ID NO: 909) | 20 | downstream |
| CEP290-B1206 | + | AAAAGCUUUUGAGCUAA (SEQ ID NO: 767) | 17 | upstream |
| CEP290-B1207 | + | AAAGAACAUACAUAAGA (SEQ ID NO: 911) | 17 | downstream |
| CEP290-B1208 | + | AAAUGGUUCCCUAUAUA (SEQ ID NO: 912) | 17 | downstream |
| CEP290-B1209 | + | AACAACGUUUUCAUUUA (SEQ ID NO: 765) | 17 | upstream |
| CEP290-B1210 | + | AACCUAUGUAUAAGAUG (SEQ ID NO: 914) | 17 | downstream |
| CEP290-B1211 | + | AACUAAGACACUGCCAA (SEQ ID NO: 915) | 17 | downstream |
| CEP290-B1212 | + | AAGACUGGAGAUAGAGA (SEQ ID NO: 916) | 17 | downstream |
| CEP290-B1213 | + | AAGACUUAUAUUCCAUU (SEQ ID NO: 917) | 17 | downstream |
| CEP290-B1214 | + | AAGAUGAAAAAUACUCU (SEQ ID NO: 918) | 17 | upstream |
| CEP290-B1215 | – | AAGCAUACUUUUUUUAA (SEQ ID NO: 667) | 17 | downstream |
| CEP290-B1216 | + | AAGCCUCUAUUUCUGAU (SEQ ID NO: 920) | 17 | upstream |
| CEP290-B1217 | – | AAGCUUUUGCUGGCUCA (SEQ ID NO: 766) | 17 | upstream |

TABLE 5D-continued

| gRNA Name | DNA Strand | Targeting Domain | Target Site Length | Position relative to mutation |
|---|---|---|---|---|
| CEP290-B1218 | + | AAGUUUUGAAACAGGAA (SEQ ID NO: 922) | 17 | downstream |
| CEP290-B1219 | + | ACAAGAUGUCUCUUGCC (SEQ ID NO: 923) | 17 | upstream |
| CEP290-B1220 | + | ACAGAGGACAUGGAGAA (SEQ ID NO: 715) | 17 | upstream |
| CEP290-B1221 | + | ACAGGAAUAGAAAUUCA (SEQ ID NO: 925) | 17 | downstream |
| CEP290-B1222 | + | ACAUGGGAGUCACAGGG (SEQ ID NO: 926) | 17 | downstream |
| CEP290-B1223 | − | ACGUUAUCAUUUUCCCA (SEQ ID NO: 927) | 17 | upstream |
| CEP290-B1224 | + | ACUAAGACACUGCCAAU (SEQ ID NO: 603) | 17 | downstream |
| CEP290-B1225 | + | AGAAAGAACACUGUGGU (SEQ ID NO: 928) | 17 | downstream |
| CEP290-B1226 | + | AGACUGGAGAUAGAGAC (SEQ ID NO: 664) | 17 | downstream |
| CEP290-B1227 | + | AGACUUAUAUUCCAUUA (SEQ ID NO: 651) | 17 | downstream |
| CEP290-B1228 | − | AGAGACACAUUCAGUAA (SEQ ID NO: 754) | 17 | up stream |
| CEP290-B1229 | − | AGAGUUCAAGCUAAUAC (SEQ ID NO: 931) | 17 | downstream |
| CEP290-B1230 | − | AGAUCCUUUCACAGGAG (SEQ ID NO: 932) | 17 | up stream |
| CEP290-B1231 | + | AGAUGAAAAAUACUCUU (SEQ ID NO: 718) | 17 | up stream |
| CEP290-B1232 | + | AGAUGACAUGAGGUAAG (SEQ ID NO: 934) | 17 | downstream |
| CEP290-B1233 | − | AGCAAGAGAUGAACUAG (SEQ ID NO: 935) | 17 | downstream |
| CEP290-B1234 | + | AGCCUCUAUUUCUGAUG (SEQ ID NO: 709) | 17 | up stream |
| CEP290-B1235 | + | AGGAAGAUGAACAAAUC (SEQ ID NO: 717) | 17 | up stream |
| CEP290-B1236 | + | AGGACUUUCUAAUGCUG (SEQ ID NO: 938) | 17 | up stream |
| CEP290-B1237 | + | AGGAGAUACUCAACACA (SEQ ID NO: 939) | 17 | downstream |
| CEP290-B1238 | + | AGGAUAGGACAGAGGAC (SEQ ID NO: 940) | 17 | up stream |
| CEP290-B1239 | − | AGGAUUCCUACUAAAUU (SEQ ID NO: 941) | 17 | up stream |
| CEP290-B1240 | − | AGGAUUCCUACUAAAUU (SEQ ID NO: 941) | 17 | up stream |
| CEP290-B1241 | + | AGGGUAGGAUUCAUGUU (SEQ ID NO: 942) | 17 | downstream |
| CEP290-B1242 | − | AGUUCAAGCUAAUACAU (SEQ ID NO: 943) | 17 | downstream |

TABLE 5D-continued

| gRNA Name | DNA Strand | Targeting Domain | Target Site Length | Position relative to mutation |
|---|---|---|---|---|
| CEP290-B1243 | + | AUAAGCCUCUAUUUCUG (SEQ ID NO: 944) | 17 | up stream |
| CEP290-B1244 | − | AUAAGUCUUUUGAUAUA (SEQ ID NO: 661) | 17 | downstream |
| CEP290-B1245 | + | AUAAUUUAGUAGGAAUC (SEQ ID NO: 946) | 17 | up stream |
| CEP290-B1246 | + | AUAAUUUAGUAGGAAUC (SEQ ID NO: 946) | 17 | upstream |
| CEP290-B1247 | − | AUACCUUUUACUGAGGA (SEQ ID NO: 947) | 17 | upstream |
| CEP290-B1248 | − | AUAGAGGCUUAUGGAUU (SEQ ID NO: 948) | 17 | upstream |
| CEP290-B1249 | + | AUAGGACAGAGGACAUG (SEQ ID NO: 949) | 17 | upstream |
| CEP290-B1250 | − | AUAUCUGUCUUCCUUAA (SEQ ID NO: 658) | 17 | downstream |
| CEP290-B1251 | − | AUCAGAAAUAGAGGCUU (SEQ ID NO: 951) | 17 | upstream |
| CEP290-B1252 | + | AUCAUUCUUGUGGCAGU (SEQ ID NO: 952) | 17 | downstream |
| CEP290-B1253 | − | AUCCUCCUUACUGCCAC (SEQ ID NO: 953) | 17 | downstream |
| CEP290-B1254 | − | AUCUAAGAUCCUUUCAC (SEQ ID NO: 696) | 17 | upstream |
| CEP290-B1255 | − | AUCUUCCUCAUCAGAAA (SEQ ID NO: 955) | 17 | upstream |
| CEP290-B1256 | + | AUGACAUGAGGUAAGUA (SEQ ID NO: 656) | 17 | downstream |
| CEP290-B1257 | + | AUGACUCAUAAUUUAGU (SEQ ID NO: 704) | 17 | upstream |
| CEP290-B1258 | + | AUGACUCAUAAUUUAGU (SEQ ID NO: 704) | 17 | upstream |
| CEP290-B1259 | − | AUGAGAGUGAUUAGUGG (SEQ ID NO: 645) | 17 | downstream |
| CEP290-B1260 | − | AUUAGAAAGUCCUAGGC (SEQ ID NO: 957) | 17 | upstream |
| CEP290-B1261 | + | AUUCUUGUGGCAGUAAG (SEQ ID NO: 958) | 17 | downstream |
| CEP290-B1262 | + | CACUCUCAUGUAUUAGC (SEQ ID NO: 959) | 17 | downstream |
| CEP290-B1263 | − | CAUAUCUGUCUUCCUUA (SEQ ID NO: 960) | 17 | downstream |
| CEP290-B1264 | + | CAUGACUCAUAAUUUAG (SEQ ID NO: 961) | 17 | upstream |
| CEP290-B1265 | + | CAUGACUCAUAAUUUAG (SEQ ID NO: 961) | 17 | upstream |
| CEP290-B1266 | − | CAUGAGAGUGAUUAGUG (SEQ ID NO: 962) | 17 | downstream |
| CEP290-B1267 | + | CCUAGGACUUUCUAAUG (SEQ ID NO: 963) | 17 | upstream |

TABLE 5D-continued

| gRNA Name | DNA Strand | Targeting Domain | Target Site Length | Position relative to mutation |
|---|---|---|---|---|
| CEP290-B1268 | − | CCUAUCCUCUCCAGCAU (SEQ ID NO: 964) | 17 | upstream |
| CEP290-B1269 | + | CUAGGACUUUCUAAUGC (SEQ ID NO: 695) | 17 | upstream |
| CEP290-B1270 | − | CUCAUGUCAUCUAGAGC (SEQ ID NO: 966) | 17 | downstream |
| CEP290-B1271 | + | CUCUUGCUCUAGAUGAC (SEQ ID NO: 967) | 17 | downstream |
| CEP290-B1272 | + | CUCUUUGGCAAAAGCAG (SEQ ID NO: 968) | 17 | upstream |
| CEP290-B1273 | + | CUCUUUGGCAAAAGCAG (SEQ ID NO: 968) | 17 | upstream |
| CEP290-B1274 | + | CUGAACAAGUUUUGAAA (SEQ ID NO: 970) | 17 | downstream |
| CEP290-B1275 | + | CUGAGCAAAACAACUGG (SEQ ID NO: 971) | 17 | downstream |
| CEP290-B1276 | − | CUGCUGCUUUUGCCAAA (SEQ ID NO: 972) | 17 | upstream |
| CEP290-B1277 | − | CUGCUGCUUUUGCCAAA (SEQ ID NO: 972) | 17 | upstream |
| CEP290-B1278 | + | CUGGAGAGGAUAGGACA (SEQ ID NO: 973) | 17 | upstream |
| CEP290-B1279 | − | UAAAUGAAAACGUUGUU (SEQ ID NO: 974) | 17 | upstream |
| CEP290-B1280 | − | UAAAUGAAAACGUUGUU (SEQ ID NO: 974) | 17 | upstream |
| CEP290-B1281 | − | UAAGCAUACUUUUUUUA (SEQ ID NO: 975) | 17 | downstream |
| CEP290-B1282 | + | UAAGGAGGAUGUAAGAC (SEQ ID NO: 648) | 17 | downstream |
| CEP290-B1283 | + | UAAUGCCUGAACAAGUU (SEQ ID NO: 976) | 17 | downstream |
| CEP290-B1284 | − | UAAUUUGUUUCUGUGUG (SEQ ID NO: 977) | 17 | downstream |
| CEP290-B1285 | + | UACAAAAGAACAUACAU (SEQ ID NO: 978) | 17 | downstream |
| CEP290-B1286 | − | UAGGCAAGAGACAUCUU (SEQ ID NO: 979) | 17 | upstream |
| CEP290-B1287 | − | UAUAAGUCUUUUGAUAU (SEQ ID NO: 980) | 17 | downstream |
| CEP290-B1288 | − | UAUCUAAGAUCCUUUCA (SEQ ID NO: 981) | 17 | upstream |
| CEP290-B1289 | + | UAUUUCUGAUGAGGAAG (SEQ ID NO: 982) | 17 | upstream |
| CEP290-B1290 | + | UCACUGAGCAAAACAAC (SEQ ID NO: 650) | 17 | downstream |
| CEP290-B1291 | + | UCAUUCUUGUGGCAGUA (SEQ ID NO: 2780) | 17 | downstream |
| CEP290-B1292 | − | UCCAGUUGUUUUGCUCA (SEQ ID NO: 983) | 17 | downstream |

TABLE 5D-continued

| gRNA Name | DNA Strand | Targeting Domain | Target Site Length | Position relative to mutation |
|---|---|---|---|---|
| CEP290-B1293 | + | UCUAAUGCUGGAGAGGA (SEQ ID NO: 984) | 17 | upstream |
| CEP290-B1294 | + | UGAACAAGUUUUGAAAC (SEQ ID NO: 659) | 17 | downstream |
| CEP290-B1295 | + | UGAACUCUGUGCCAAAC (SEQ ID NO: 638) | 17 | downstream |
| CEP290-B1296 | + | UGACAGUUUUUAAGGCG (SEQ ID NO: 642) | 17 | downstream |
| CEP290-B1297 | + | UGAGCCAGCAAAAGCUU (SEQ ID NO: 752) | 17 | upstream |
| CEP290-B1298 | + | UGCAGAACUAGUGUAGA (SEQ ID NO: 987) | 17 | downstream |
| CEP290-B1299 | + | UGCCAAUAGGGAUAGGU (SEQ ID NO: 614) | 17 | downstream |
| CEP290-B1300 | − | UGCUCUUUCUAUAUAU (SEQ ID NO: 663) | 17 | downstream |
| CEP290-B1301 | + | UGCUGGAGAGGAUAGGA (SEQ ID NO: 989) | 17 | upstream |
| CEP290-B1302 | − | UGUCAAAUAUGGUGCUU (SEQ ID NO: 643) | 17 | downstream |
| CEP290-B1303 | − | UGUUUAUCAAUAUUAUU (SEQ ID NO: 990) | 17 | upstream |
| CEP290-B1304 | − | UGUUUAUCAAUAUUAUU (SEQ ID NO: 990) | 17 | upstream |
| CEP290-B1305 | + | UUAAAAAAAGUAUGCUU (SEQ ID NO: 991) | 17 | downstream |
| CEP290-B1306 | + | UUAAGGCGGGGAGUCAC (SEQ ID NO: 992) | 17 | downstream |
| CEP290-B1307 | + | UUACUGAAUGUGUCUCU (SEQ ID NO: 993) | 17 | upstream |
| CEP290-B1308 | + | UUACUGAAUGUGUCUCU (SEQ ID NO: 993) | 17 | upstream |
| CEP290-B1309 | + | UUAUUCUACUCCUGUGA (SEQ ID NO: 768) | 17 | upstream |
| CEP290-B1310 | + | UUCACUGAGCAAAACAA (SEQ ID NO: 995) | 17 | downstream |
| CEP290-B1311 | − | UUCUGCUGCUUUUGCCA (SEQ ID NO: 996) | 17 | upstream |
| CEP290-B1312 | − | UUCUGCUGCUUUUGCCA (SEQ ID NO: 996) | 17 | upstream |
| CEP290-B1313 | + | UUGAACUCUGUGCCAAA (SEQ ID NO: 997) | 17 | downstream |
| CEP290-B1314 | + | UUGACAGUUUUUAAGGC (SEQ ID NO: 654) | 17 | downstream |
| CEP290-B1315 | − | UUGUGGAUAAUGUAUCA (SEQ ID NO: 999) | 17 | upstream |
| CEP290-B1316 | − | UUGUUCAUCUUCCUCAU (SEQ ID NO: 1000) | 17 | upstream |
| CEP290-B1317 | − | UUGUUCUGAGUAGCUUU (SEQ ID NO: 753) | 17 | upstream |

TABLE 5D-continued

| gRNA Name | DNA Strand | Targeting Domain | Target Site Length | Position relative to mutation |
|---|---|---|---|---|
| CEP290-B1318 | + | UUUGACAGUUUUUAAGG (SEQ ID NO: 662) | 17 | downstream |
| CEP290-B1319 | + | UUUUGACAGUUUUUAAG (SEQ ID NO: 1003) | 17 | downstream |

Table 6A provides targeting domains for break-induced deletion of genomic sequence including the mutation at the LCA10 target position in the CEP290 gene selected according to the first tier parameters. The targeting domains are within 400 bp upstream of an Alu repeat or 700 bp downstream of the mutation, have good orthogonality, and start with G. It is contemplated herein that the targeting domain hybridizes to the target domain through complementary base pairing. Any of the targeting domains in the table can be used with a N. meningitidis Cas9 molecule that generates a double stranded break (Cas9 nuclease) or a single-stranded break (Cas9 nickase).

TABLE 6A

| gRNA Name | DNA Strand | Targeting Domain | Target Site Length | Position relative to mutation |
|---|---|---|---|---|
| CEP290-B65 | − | GAGUUCAAGCUAAUACAUGA (SEQ ID NO: 589) | 20 | downstream |
| CEP290-B296 | − | GUUGUUCUGAGUAGCUU (SEQ ID NO: 590) | 17 | upstream |
| CEP290-B308 | + | GGCAAAAGCAGCAGAAAGCA (SEQ ID NO: 591) | 20 | upstream |
| CEP290-B536 | − | GUUGUUCUGAGUAGCUU (SEQ ID NO: 590) | 17 | upstream |
| CEP290-B482 | + | GGCAAAAGCAGCAGAAAGCA (SEQ ID NO: 591) | 20 | upstream |

Table 6B provides targeting domains for break-induced deletion of genomic sequence including the mutation at the LCA10 target position in the CEP290 gene selected according to the second tier parameters. The targeting domains are within 400 bp upstream of an Alu repeat or 700 bp downstream of the mutation, have good orthogonality, and do not start with G. It is contemplated herein that the targeting domain hybridizes to the target domain through complementary base pairing. Any of the targeting domains in the table can be used with a N. meningitidis Cas9 molecule that generates a double stranded break (Cas9 nuclease) or a single-stranded break (Cas9 nickase).

TABLE 6B

| gRNA Name | DNA Strand | Targeting Domain | Target Site Length | Position relative to mutation |
|---|---|---|---|---|
| CEP290-B235 | − | UUCAAGCUAAUACAUGA (SEQ ID NO: 1004) | 17 | downstream |
| CEP290-B109 | + | CACAUGGGAGUCACAGG (SEQ ID NO: 1005) | 17 | downstream |
| CEP290-B129 | + | AGUCACAUGGGAGUCACAGG (SEQ ID NO: 1006) | 20 | downstream |

TABLE 6B-continued

| gRNA Name | DNA Strand | Targeting Domain | Target Site Length | Position relative to mutation |
|---|---|---|---|---|
| CEP290-B295 | − | AAUAGAGGCUUAUGGAU (SEQ ID NO: 1007) | 17 | upstream |
| CEP290-B297 | − | CUGAGGACAGAACAAGC (SEQ ID NO: 1008) | 17 | upstream |
| CEP290-B298 | − | CAUCAGAAAUAGAGGCU (SEQ ID NO: 1009) | 17 | upstream |
| CEP290-B299 | − | CUGCUUUUGCCAAAGAG (SEQ ID NO: 711) | 17 | upstream |
| CEP290-B300 | + | AGCAGAAAGCAAACUGA (SEQ ID NO: 1011) | 17 | upstream |
| CEP290-B301 | + | AAAAGCAGCAGAAAGCA (SEQ ID NO: 1012) | 17 | upstream |
| CEP290-B302 | − | UUACUGAGGACAGAACAAGC (SEQ ID NO: 1013) | 20 | upstream |
| CEP290-B303 | − | AACGUUGUUCUGAGUAGCUU (SEQ ID NO: 1014) | 20 | upstream |
| CEP290-B304 | − | CUGCUGCUUUUGCCAAAGAG (SEQ ID NO: 725) | 20 | upstream |
| CEP290-B305 | − | AGAAAUAGAGGCUUAUGGAU (SEQ ID NO: 1016) | 20 | upstream |
| CEP290-B306 | − | CCUCAUCAGAAAUAGAGGCU (SEQ ID NO: 1017) | 20 | upstream |
| CEP290-B307 | + | AGCAGCAGAAAGCAAACUGA (SEQ ID NO: 1018) | 20 | upstream |
| CEP290-B531 | − | CUGCUUUUGCCAAAGAG (SEQ ID NO: 711) | 17 | upstream |
| CEP290-B522 | + | AGCAGAAAGCAAACUGA (SEQ ID NO: 1011) | 17 | upstream |
| CEP290-B537 | + | AAAAGCAGCAGAAAGCA (SEQ ID NO: 1012) | 17 | upstream |
| CEP290-B504 | − | AACGUUGUUCUGAGUAGCUU (SEQ ID NO: 1014) | 20 | upstream |
| CEP290-B478 | − | CUGCUGCUUUUGCCAAAGAG (SEQ ID NO: 725) | 20 | upstream |
| CEP290-B526 | + | AGCAGCAGAAAGCAAACUGA (SEQ ID NO: 1018) | 20 | upstream |

Table 7A provides targeting domains for introduction of an indel (e.g., mediated by NHEJ) in close proximity to or including the LCA10 target position in the CEP290 gene selected according to the first tier parameters. The targeting domains are within 40 bases of the LCA10 target position, have good orthogonality, start with G and PAM is NNGRRT. It is contemplated herein that in an embodiment the targeting domain hybridizes to the target domain through complementary base pairing. Any of the targeting domains in the table can be used with a S. aureus Cas9 molecule that generates a double stranded break (Cas9 nuclease) or a single-stranded break (Cas9 nickase).

TABLE 7A

| gRNA Name | DNA Strand | Targeting Domain | Target Site Length |
|---|---|---|---|
| CEP290-12 | − | GCACCUGGCCCCAGUUGUAAUU (SEQ ID NO: 398) | 22 |

Table 7B provides targeting domains for introduction of an indel (e.g., mediated by NHEJ) in close proximity to or including the LCA10 target position in the CEP290 gene selected according to the second tier parameters. The targeting domains are within 40 bases of the LCA10 target position, have good orthogonality, and PAM is NNGRRT. It is contemplated herein that the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 7B

| gRNA Name | DNA Strand | Targeting Domain | Target Site Length |
|---|---|---|---|
| CEP290-35 | + | AAAUAAAACUAAGACACUGCCAAU (SEQ ID NO: 1025) | 24 |
| CEP290-36 | + | AAUAAAACUAAGACACUGCCAAU (SEQ ID NO: 1026) | 23 |
| CEP290-37 | + | AUAAAACUAAGACACUGCCAAU (SEQ ID NO: 1027) | 22 |
| CEP290-38 | + | AAAACUAAGACACUGCCAAU (SEQ ID NO: 610) | 20 |
| CEP290-39 | + | AAACUAAGACACUGCCAAU (SEQ ID NO: 1028) | 19 |
| CEP290-40 | + | AACUAAGACACUGCCAAU (SEQ ID NO: 1029) | 18 |
| CEP290-512 | − | ACCUGGCCCCAGUUGUAAUU (SEQ ID NO: 616) | 20 |
| CEP290-17 | − | CCGCACCUGGCCCCAGUUGUAAUU (SEQ ID NO: 1030) | 24 |
| CEP290-41 | − | CGCACCUGGCCCCAGUUGUAAUU (SEQ ID NO: 1031) | 23 |
| CEP290-42 | − | CACCUGGCCCCAGUUGUAAUU (SEQ ID NO: 1032) | 21 |
| CEP290-513 | − | CCUGGCCCCAGUUGUAAUU (SEQ ID NO: 1033) | 19 |
| CEP290-514 | − | CUGGCCCCAGUUGUAAUU (SEQ ID NO: 1034) | 18 |
| CEP290-43 | + | UAAAACUAAGACACUGCCAAU (SEQ ID NO: 1035) | 21 |

Table 7C provides targeting domains for introduction of an indel (e.g., mediated by NHEJ) in close proximity to or including the LCA10 target position in the CEP290 gene selected according to the fifth tier parameters. The targeting domains are within 40 bases of the LCA10 target position, and PAM is NNGRRV. It is contemplated herein that the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 7C

| gRNA Name | DNA Strand | Targeting Domain | Target Site Length |
|---|---|---|---|
| CEP290-44 | + | AAAAUAAACUAAGACACUGCCAA (SEQ ID NO: 1036) | 24 |
| CEP290-45 | + | AAAUAAAACUAAGACACUGCCAA (SEQ ID NO: 1037) | 23 |
| CEP290-46 | + | AAUAAAACUAAGACACUGCCAA (SEQ ID NO: 1038) | 22 |
| CEP290-47 | + | AUAAAACUAAGACACUGCCAA (SEQ ID NO: 1039) | 21 |
| CEP290-48 | + | AAAACUAAGACACUGCCAA (SEQ ID NO: 1040) | 19 |
| CEP290-49 | + | AAACUAAGACACUGCCAA (SEQ ID NO: 1041) | 18 |
| CEP290-16 | + | AAGACACUGCCAAUAGGGAUAGGU (SEQ ID NO: 1042) | 24 |
| CEP290-50 | + | AGACACUGCCAAUAGGGAUAGGU (SEQ ID NO: 1043) | 23 |
| CEP290-51 | + | ACACUGCCAAUAGGGAUAGGU (SEQ ID NO: 1044) | 21 |
| CEP290-510 | + | ACUGCCAAUAGGGAUAGGU (SEQ ID NO: 1045) | 19 |
| CEP290-509 | + | CACUGCCAAUAGGGAUAGGU (SEQ ID NO: 613) | 20 |
| CEP290-511 | + | CUGCCAAUAGGGAUAGGU (SEQ ID NO: 1046) | 18 |
| CEP290-11 | + | GACACUGCCAAUAGGGAUAGGU (SEQ ID NO: 1047) | 22 |
| CEP290-52 | + | UAAAACUAAGACACUGCCAA (SEQ ID NO: 871) | 20 |
| CEP290-13 | + | AUGAGAUACUCACAAUUACAAC (SEQ ID NO: 1049) | 22 |
| CEP290-53 | + | AGAUACUCACAAUUACAAC (SEQ ID NO: 1050) | 19 |
| CEP290-18 | + | GUAUGAGAUACUCACAAUUACAAC (SEQ ID NO: 1051) | 24 |
| CEP290-54 | + | GAGAUACUCACAAUUACAAC (SEQ ID NO: 395) | 20 |
| CEP290-55 | + | GAUACUCACAAUUACAAC (SEQ ID NO: 1052) | 18 |
| CEP290-14 | + | UAUGAGAUACUCACAAUUACAAC (SEQ ID NO: 1053) | 23 |
| CEP290-57 | + | UGAGAUACUCACAAUUACAAC (SEQ ID NO: 1054) | 21 |
| CEP290-58 | + | AUGAGAUAUUCACAAUUACAA (SEQ ID NO: 1055) | 21 |
| CEP290-59 | + | AGAUAUUCACAAUUACAA (SEQ ID NO: 1056) | 18 |
| CEP290-19 | + | GGUAUGAGAUAUUCACAAUUACAA (SEQ ID NO: 1057) | 24 |
| CEP290-61 | + | GUAUGAGAUAUUCACAAUUACAA (SEQ ID NO: 1058) | 23 |
| CEP290-63 | + | GAGAUAUUCACAAUUACAA (SEQ ID NO: 1059) | 19 |

TABLE 7C-continued

| gRNA Name | DNA Strand | Targeting Domain | Target Site Length |
|---|---|---|---|
| CEP290-65 | + | UAUGAGAUAUUCACAAUUACAA (SEQ ID NO: 1060) | 22 |
| CEP290-66 | + | UGAGAUAUUCACAAUUACAA (SEQ ID NO: 1061) | 20 |

Table 7D provides targeting domains for introduction of an indel (e.g., mediated by NHEJ) in close proximity to or including the LCA10 target position in the CEP290 gene that can be used for dual targeting. Any of the targeting domains in the table can be used with a *S. aureus* Cas9 (nickase) molecule to generate a single stranded break. Exemplary nickase pairs including selecting a targeting domain from Group A and a second targeting domain from Group B. It is contemplated herein that a targeting domain of Group A can be combined with any of the targeting domains of Group B.

For example, the CEP290-12 or CEP290-17 can be combined with CEP290-11 or CEP290-16.

TABLE 7D

| Group A | Group B |
|---|---|
| CEP290-12 | CEP290-11 |
| CEP290-17 | CEP290-16 |

Table 8A provides targeting domains for break-induced deletion of genomic sequence including the mutation at the LCA10 target position in the CEP290 gene selected according to the first tier parameters. The targeting domains are within 1000 bp upstream of an Alu repeat, within 40 bp upstream of mutation, or 1000 bp downstream of the mutation, have good orthogonality, and start with G. It is contemplated herein that the targeting domain hybridizes to the target domain through complementary base pairing. Any of the targeting domains in the table can be used with a *S. pyogenes* Cas9 molecule that generates a double stranded break (Cas9 nuclease) or a single-stranded break (Cas9 nickase).

TABLE 8A

| gRNA Name | DNA Strand | Targeting Domain | Target Site Length | Position relative to mutation |
|---|---|---|---|---|
| CEP290-67 | + | GAAAGAUGAAAAAUACUCUU (SEQ ID NO: 462) | 20 | upstream |
| CEP290-68 | − | GAAAUAGAUGUAGAUUG (SEQ ID NO: 463) | 17 | downstream |
| CEP290-70 | − | GAAAUAUUAAGGGCUCUUCC (SEQ ID NO: 464) | 20 | upstream |
| CEP290-71 | + | GAACAAAAGCCAGGGACCAU (SEQ ID NO: 465) | 20 | upstream |
| CEP290-72 | − | GAACUCUAUACCUUUUACUG (SEQ ID NO: 466) | 20 | upstream |
| CEP290-73 | − | GAAGAAUGGAAUAGAUAAUA (SEQ ID NO: 467) | 20 | downstream |
| CEP290-74 | + | GAAUAGUUUGUUCUGGGUAC (SEQ ID NO: 468) | 20 | upstream |
| CEP290-75 | − | GAAUGGAAUAGAUAAUA (SEQ ID NO: 469) | 17 | downstream |
| CEP290-76 | + | GAAUUUACAGAGUGCAUCCA (SEQ ID NO: 470) | 20 | upstream |
| CEP290-77 | − | GAGAAAAGGAGCAUGAAAC (SEQ ID NO: 471) | 20 | upstream |
| CEP290-78 | − | GAGAGCCACAGUGCAUG (SEQ ID NO: 472) | 17 | downstream |
| CEP290-79 | − | GAGGUAGAAUCAAGAAG (SEQ ID NO: 473) | 17 | downstream |
| CEP290-80 | + | GAGUGCAUCCAUGGUCC (SEQ ID NO: 474) | 17 | upstream |
| CEP290-81 | + | GAUAACUACAAAGGGUC (SEQ ID NO: 475) | 17 | upstream |
| CEP290-82 | + | GAUAGAGACAGGAAUAA (SEQ ID NO: 476) | 17 | downstream |
| CEP290-83 | + | GAUGAAAAAUACUCUUU (SEQ ID NO: 477) | 17 | upstream |

TABLE 8A-continued

| gRNA Name | DNA Strand | Targeting Domain | Target Site Length | Position relative to mutation |
|---|---|---|---|---|
| CEP290-84 | + | GAUGACAUGAGGUAAGU (SEQ ID NO: 478) | 17 | downstream |
| CEP290-85 | + | GAUGCAGAACUAGUGUAGAC (SEQ ID NO: 460) | 20 | downstream |
| CEP290-86 | + | GCAGAACUAGUGUAGAC (SEQ ID NO: 458) | 17 | downstream |
| CEP290-87 | - | GCAUGUGGUGUCAAAUA (SEQ ID NO: 479) | 17 | downstream |
| CEP290-88 | + | GCCUGAACAAGUUUUGAAAC (SEQ ID NO: 480) | 20 | downstream |
| CEP290-89 | - | GCUACCGGUUACCUGAA (SEQ ID NO: 457) | 17 | downstream |
| CEP290-90 | - | GCUCUUUCUAUAUAUA (SEQ ID NO: 481) | 17 | downstream |
| CEP290-91 | + | GCUUGAACUCUGUGCCAAAC (SEQ ID NO: 461) | 20 | downstream |
| CEP290-92 | + | GCUUUUGACAGUUUUUAAGG (SEQ ID NO: 482) | 20 | downstream |
| CEP290-93 | - | GCUUUUGUUCCUUGGAA (SEQ ID NO: 483) | 17 | upstream |
| CEP290-94 | + | GGAACAAAAGCCAGGGACCA (SEQ ID NO: 484) | 20 | upstream |
| CEP290-95 | + | GGACUUGACUUUUACCCUUC (SEQ ID NO: 485) | 20 | downstream |
| CEP290-96 | + | GGAGAAUAGUUUGUUCU (SEQ ID NO: 486) | 17 | upstream |
| CEP290-97 | + | GGAGUCACAUGGGAGUCACA (SEQ ID NO: 487) | 20 | downstream |
| CEP290-98 | + | GGAUAGGACAGAGGACA (SEQ ID NO: 488) | 17 | upstream |
| CEP290-99 | + | GGCUGUAAGAUAACUACAAA (SEQ ID NO: 489) | 20 | upstream |
| CEP290-100 | + | GGGAGAAUAGUUUGUUC (SEQ ID NO: 490) | 17 | upstream |
| CEP290-101 | + | GGGAGUCACAUGGGAGUCAC (SEQ ID NO: 491) | 20 | downstream |
| CEP290-102 | - | GGGCUCUUCCUGGACCA (SEQ ID NO: 492) | 17 | upstream |
| CEP290-103 | + | GGGUACAGGGGUAAGAGAAA (SEQ ID NO: 493) | 20 | upstream |
| CEP290-104 | - | GGUCCCUGGCUUUUGUUCCU (SEQ ID NO: 494) | 20 | upstream |
| CEP290-105 | - | GUAAAGGUUCAUGAGACUAG (SEQ ID NO: 495) | 20 | downstream |
| CEP290-106 | + | GUAACAUAAUCACCUCUCUU (SEQ ID NO: 496) | 20 | upstream |
| CEP290-107 | + | GUAAGACUGGAGAUAGAGAC (SEQ ID NO: 497) | 20 | downstream |
| CEP290-108 | + | GUACAGGGGUAAGAGAA (SEQ ID NO: 498) | 17 | upstream |

TABLE 8A-continued

| gRNA Name | DNA Strand | Targeting Domain | Target Site Length | Position relative to mutation |
|---|---|---|---|---|
| CEP290-109 | + | GUAGCUUUUGACAGUUUUUA (SEQ ID NO: 499) | 20 | downstream |
| CEP290-110 | + | GUCACAUGGGAGUCACA (SEQ ID NO: 500) | 17 | downstream |
| CEP290-111 | − | GUGGAGAGCCACAGUGCAUG (SEQ ID NO: 501) | 20 | downstream |
| CEP290-112 | − | GUUACAAUCUGUGAAUA (SEQ ID NO: 502) | 17 | upstream |
| CEP290-113 | + | GUUCUGUCCUCAGUAAA (SEQ ID NO: 503) | 17 | upstream |
| CEP290-114 | − | GUUGAGUAUCUCCUGUU (SEQ ID NO: 459) | 17 | downstream |
| CEP290-115 | + | GUUUAGAAUGAUCAUUCUUG (SEQ ID NO: 504) | 20 | downstream |
| CEP290-116 | + | GUUUGUUCUGGGUACAG (SEQ ID NO: 505) | 17 | upstream |
| CEP290-117 | − | UAAAAACUGUCAAAAGCUAC (SEQ ID NO: 506) | 20 | downstream |
| CEP290-118 | + | UAAAAGGUAUAGAGUUCAAG (SEQ ID NO: 507) | 20 | upstream |
| CEP290-119 | + | UAAAUCAUGCAAGUGACCUA (SEQ ID NO: 508) | 20 | upstream |
| CEP290-120 | + | UAAGAUAACUACAAAGGGUC (SEQ ID NO: 509) | 20 | upstream |

Table 8B provides targeting domains for break-induced deletion of genomic sequence including the mutation at the LCA10 target position in the CEP290 gene selected according to the second tier parameters. The targeting domains are within 1000 bp upstream of an Alu repeat, within 40 bp upstream of mutation, or 1000 bp downstream of the mutation, have good orthogonality, and do not start with G. It is contemplated herein that the targeting domain hybridizes to the target domain through complementary base pairing. Any of the targeting domains in the table can be used with a *S. pyogenes* Cas9 molecule that generates a double stranded break (Cas9 nuclease) or a single-stranded break (Cas9 nickase).

TABLE 8B

| gRNA Name | DNA Strand | Targeting Domain | Target Site Length | Position relative to mutation |
|---|---|---|---|---|
| CEP290-121 | − | AAAAAGGAGCAUGAAAC (SEQ ID NO: 1062) | 17 | upstream |
| CEP290-122 | + | AAAACUAAGACACUGCCAAU (SEQ ID NO: 610) | 20 | downstream |
| CEP290-123 | + | AAAAGACUUAUAUUCCAUUA (SEQ ID NO: 685) | 20 | downstream |
| CEP290-124 | − | AAAAGCUACCGGUUACCUGA (SEQ ID NO: 621) | 20 | downstream |
| CEP290-125 | − | AAAAUUAUGCCUAUUUAGUG (SEQ ID NO: 729) | 20 | upstream |
| CEP290-126 | + | AAACAACUGGAAGAGAGAAA (SEQ ID NO: 691) | 20 | downstream |
| CEP290-127 | + | AAACUAAGACACUGCCAAUA (SEQ ID NO: 609) | 20 | downstream |

TABLE 8B-continued

| gRNA Name | DNA Strand | Targeting Domain | Target Site Length | Position relative to mutation |
|---|---|---|---|---|
| CEP290-128 | − | AAACUGUCAAAAGCUAC (SEQ ID NO: 655) | 17 | downstream |
| CEP290-129 | − | AAAGAAAUAGAUGUAGAUUG (SEQ ID NO: 1066) | 20 | downstream |
| CEP290-130 | + | AAAGAUGAAAAAUACUCUUU (SEQ ID NO: 737) | 20 | upstream |
| CEP290-131 | − | AAAGCUACCGGUUACCUGAA (SEQ ID NO: 620) | 20 | downstream |
| CEP290-133 | − | AAAUAGAGGCUUAUGGAUUU (SEQ ID NO: 731) | 20 | upstream |
| CEP290-134 | + | AAAUUAUCACCACACUAAAU (SEQ ID NO: 727) | 20 | upstream |
| CEP290-135 | − | AACAAACUAUUCUCCCA (SEQ ID NO: 1070) | 17 | upstream |
| CEP290-136 | − | AACAGUAGCUGAAAUAUUAA (SEQ ID NO: 1071) | 20 | upstream |
| CEP290-137 | + | AACAUGACUCAUAAUUUAGU (SEQ ID NO: 721) | 20 | upstream |
| CEP290-138 | − | AACUAUUCUCCCAUGGUCCC (SEQ ID NO: 1073) | 20 | upstream |
| CEP290-140 | + | AAGACACUGCCAAUAGGGAU (SEQ ID NO: 600) | 20 | downstream |
| CEP290-141 | − | AAGGAAAUACAAAAACUGGA (SEQ ID NO: 1074) | 20 | downstream |
| CEP290-142 | + | AAGGUAUAGAGUUCAAG (SEQ ID NO: 1075) | 17 | upstream |
| CEP290-143 | − | AAGGUUCAUGAGACUAG (SEQ ID NO: 1076) | 17 | downstream |
| CEP290-144 | + | AAUAGUUUGUUCUGGGUACA (SEQ ID NO: 1077) | 20 | upstream |
| CEP290-145 | − | AAUAUAAGUCUUUUGAUAUA (SEQ ID NO: 687) | 20 | downstream |
| CEP290-146 | − | AAUAUAUUAUCUAUUUAUAG (SEQ ID NO: 1079) | 20 | upstream |
| CEP290-147 | − | AAUAUUGUAAUCAAAGG (SEQ ID NO: 1080) | 17 | upstream |
| CEP290-148 | + | AAUAUUUCAGCUACUGU (SEQ ID NO: 1081) | 17 | upstream |
| CEP290-149 | − | AAUUAUUGUUGCUUUUUGAG (SEQ ID NO: 1082) | 20 | downstream |
| CEP290-150 | + | AAUUCACUGAGCAAAACAAC (SEQ ID NO: 678) | 20 | downstream |
| CEP290-151 | + | ACAAAAGCCAGGGACCA (SEQ ID NO: 1084) | 17 | upstream |
| CEP290-152 | + | ACACUGCCAAUAGGGAU (SEQ ID NO: 595) | 17 | downstream |
| CEP290-153 | + | ACAGAGUGCAUCCAUGGUCC (SEQ ID NO: 1085) | 20 | upstream |
| CEP290-154 | + | ACAUAAUCACCUCUCUU (SEQ ID NO: 712) | 17 | upstream |

TABLE 8B-continued

| gRNA Name | DNA Strand | Targeting Domain | Target Site Length | Position relative to mutation |
|---|---|---|---|---|
| CEP290-155 | − | ACCAGACAUCUAAGAGAAAA (SEQ ID NO: 1087) | 20 | upstream |
| CEP290-156 | − | ACGUGCUCUUUUCUAUAUAU (SEQ ID NO: 622) | 20 | downstream |
| CEP290-157 | + | ACUUUCUAAUGCUGGAG (SEQ ID NO: 700) | 17 | upstream |
| CEP290-158 | + | ACUUUUACCCUUCAGGUAAC (SEQ ID NO: 626) | 20 | downstream |
| CEP290-159 | − | AGAAUAUUGUAAUCAAAGGA (SEQ ID NO: 1089) | 20 | upstream |
| CEP290-160 | − | AGACAUCUAAGAGAAAA (SEQ ID NO: 1090) | 17 | upstream |
| CEP290-161 | + | AGACUUAUAUUCCAUUA (SEQ ID NO: 651) | 17 | downstream |
| CEP290-162 | + | AGAGGAUAGGACAGAGGACA (SEQ ID NO: 735) | 20 | upstream |
| CEP290-163 | + | AGAUGACAUGAGGUAAGUAG (SEQ ID NO: 677) | 20 | downstream |
| CEP290-164 | + | AGAUGUCUGGUUAAAAG (SEQ ID NO: 1093) | 17 | upstream |
| CEP290-165 | + | AGCCUCUAUUUCUGAUG (SEQ ID NO: 709) | 17 | upstream |
| CEP290-166 | − | AGCUACCGGUUACCUGA (SEQ ID NO: 618) | 17 | downstream |
| CEP290-167 | − | AGCUCAAAAGCUUUUGC (SEQ ID NO: 698) | 17 | upstream |
| CEP290-168 | − | AGGAAAUACAAAAACUGGAU (SEQ ID NO: 1096) | 20 | downstream |
| CEP290-169 | + | AGGAAGAUGAACAAAUC (SEQ ID NO: 717) | 17 | upstream |
| CEP290-170 | + | AGGACAGAGGACAUGGAGAA (SEQ ID NO: 736) | 20 | upstream |
| CEP290-171 | + | AGGACUUUCUAAUGCUGGAG (SEQ ID NO: 719) | 20 | upstream |
| CEP290-172 | − | AGGCAAGAGACAUCUUG (SEQ ID NO: 708) | 17 | upstream |
| CEP290-173 | − | AGGUAGAAUAUUGUAAUCAA (SEQ ID NO: 1101) | 20 | upstream |
| CEP290-174 | − | AGUAGCUGAAAUAUUAA (SEQ ID NO: 1102) | 17 | upstream |
| CEP290-175 | + | AGUCACAUGGGAGUCAC (SEQ ID NO: 644) | 17 | downstream |
| CEP290-176 | − | AGUGCAUGUGGUGUCAAAUA (SEQ ID NO: 627) | 20 | downstream |
| CEP290-177 | + | AGUUUGUUCUGGGUACA (SEQ ID NO: 1103) | 17 | upstream |
| CEP290-178 | + | AUAAGCCUCUAUUUCUGAUG (SEQ ID NO: 723) | 20 | upstream |
| CEP290-179 | − | AUAAGUCUUUUGAUAUA (SEQ ID NO: 661) | 17 | downstream |

TABLE 8B-continued

| gRNA Name | DNA Strand | Targeting Domain | Target Site Length | Position relative to mutation |
|---|---|---|---|---|
| CEP290-180 | + | AUACAUAAGAAAGAACACUG (SEQ ID NO: 686) | 20 | downstream |
| CEP290-181 | + | AUAGUUUGUUCUGGGUACAG (SEQ ID NO: 1107) | 20 | upstream |
| CEP290-182 | − | AUAUCUGUCUUCCUUAA (SEQ ID NO: 658) | 17 | downstream |
| CEP290-183 | − | AUAUUAAGGGCUCUUCC (SEQ ID NO: 1109) | 17 | upstream |
| CEP290-184 | − | AUAUUGUAAUCAAAGGA (SEQ ID NO: 1110) | 17 | upstream |
| CEP290-185 | + | AUCAUGCAAGUGACCUA (SEQ ID NO: 1111) | 17 | upstream |
| CEP290-186 | − | AUCUAAGAUCCUUUCAC (SEQ ID NO: 696) | 17 | upstream |
| CEP290-187 | − | AUCUUCCUCAUCAGAAAUAG (SEQ ID NO: 722) | 20 | upstream |
| CEP290-188 | + | AUGACAUGAGGUAAGUA (SEQ ID NO: 656) | 17 | downstream |
| CEP290-189 | + | AUGACUCAUAAUUUAGU (SEQ ID NO: 704) | 17 | upstream |
| CEP290-190 | − | AUGAGAGUGAUUAGUGG (SEQ ID NO: 645) | 17 | downstream |
| CEP290-191 | + | AUGAGGAAGAUGAACAAAUC (SEQ ID NO: 733) | 20 | upstream |
| CEP290-192 | + | AUGGGAGAAUAGUUUGUUCU (SEQ ID NO: 1116) | 20 | upstream |
| CEP290-193 | − | AUUAGCUCAAAAGCUUUUGC (SEQ ID NO: 633) | 20 | upstream |
| CEP290-194 | − | AUUAUGCCUAUUUAGUG (SEQ ID NO: 703) | 17 | upstream |
| CEP290-195 | + | AUUCCAAGGAACAAAAGCCA (SEQ ID NO: 1118) | 20 | upstream |
| CEP290-196 | − | AUUGAGGUAGAAUCAAGAAG (SEQ ID NO: 1119) | 20 | downstream |
| CEP290-197 | + | AUUUGACACCACAUGCACUG (SEQ ID NO: 623) | 20 | downstream |
| CEP290-198 | + | CAAAAGCCAGGGACCAU (SEQ ID NO: 1120) | 17 | upstream |
| CEP290-199 | − | CAACAGUAGCUGAAAUAUUA (SEQ ID NO: 1121) | 20 | upstream |
| CEP290-200 | + | CAAGAUGUCUCUUGCCU (SEQ ID NO: 702) | 17 | upstream |
| CEP290-201 | − | CAGAACAAACUAUUCUCCCA (SEQ ID NO: 1123) | 20 | upstream |
| CEP290-202 | − | CAGAUUUCAUGUGUGAAGAA (SEQ ID NO: 1124) | 20 | downstream |
| CEP290-204 | − | CAGCAUUAGAAAGUCCU (SEQ ID NO: 710) | 17 | upstream |
| CEP290-205 | + | CAGGGGUAAGAGAAAGGGAU (SEQ ID NO: 1126) | 20 | upstream |

TABLE 8B-continued

| gRNA Name | DNA Strand | Targeting Domain | Target Site Length | Position relative to mutation |
|---|---|---|---|---|
| CEP290-206 | + | CAGUAAGGAGGAUGUAAGAC (SEQ ID NO: 676) | 20 | downstream |
| CEP290-207 | − | CAGUAGCUGAAAUAUUA (SEQ ID NO: 1128) | 17 | upstream |
| CEP290-208 | + | CAUAAGAAAGAACACUG (SEQ ID NO: 665) | 17 | downstream |
| CEP290-209 | + | CAUGGGAGAAUAGUUUGUUC (SEQ ID NO: 1130) | 20 | upstream |
| CEP290-210 | + | CAUGGGAGUCACAGGGU (SEQ ID NO: 652) | 17 | downstream |
| CEP290-211 | + | CAUUCCAAGGAACAAAAGCC (SEQ ID NO: 1131) | 20 | upstream |
| CEP290-212 | + | CCACAAGAUGUCUCUUGCCU (SEQ ID NO: 630) | 20 | upstream |
| CEP290-213 | − | CCUAGGCAAGAGACAUCUUG (SEQ ID NO: 631) | 20 | upstream |
| CEP290-214 | − | CGUGCUCUUUUCUAUAUAUA (SEQ ID NO: 624) | 20 | downstream |
| CEP290-215 | − | CGUUGUUCUGAGUAGCUUUC (SEQ ID NO: 629) | 20 | upstream |
| CEP290-216 | + | CUAAGACACUGCCAAUA (SEQ ID NO: 597) | 17 | downstream |
| CEP290-217 | + | CUAAUGCUGGAGAGGAU (SEQ ID NO: 707) | 17 | upstream |
| CEP290-218 | + | CUAGAUGACAUGAGGUAAGU (SEQ ID NO: 671) | 20 | downstream |
| CEP290-219 | + | CUAGGACUUUCUAAUGC (SEQ ID NO: 695) | 17 | upstream |
| CEP290-220 | − | CUCAUACCUAUCCCUAU (SEQ ID NO: 594) | 17 | downstream |
| CEP290-221 | − | CUCCAGCAUUAGAAAGUCCU (SEQ ID NO: 720) | 20 | upstream |
| CEP290-222 | − | CUCUAUACCUUUUACUG (SEQ ID NO: 701) | 17 | upstream |
| CEP290-223 | + | CUCUUGCUCUAGAUGACAUG (SEQ ID NO: 675) | 20 | downstream |
| CEP290-224 | − | CUGCUGCUUUUGCCAAAGAG (SEQ ID NO: 725) | 20 | upstream |
| CEP290-225 | − | CUGCUUUUGCCAAAGAG (SEQ ID NO: 711) | 17 | upstream |
| CEP290-226 | − | CUGGCUUUUGUUCCUUGGAA (SEQ ID NO: 1140) | 20 | upstream |
| CEP290-227 | + | CUGUAAGAUAACUACAA (SEQ ID NO: 1141) | 17 | upstream |
| CEP290-228 | − | CUUAAGCAUACUUUUUUUAA (SEQ ID NO: 690) | 20 | downstream |
| CEP290-229 | + | CUUAAUAUUUCAGCUACUGU (SEQ ID NO: 1143) | 20 | upstream |
| CEP290-231 | + | CUUAGAUGUCUGGUUAAAAG (SEQ ID NO: 1144) | 20 | upstream |

TABLE 8B-continued

| gRNA Name | DNA Strand | Targeting Domain | Target Site Length | Position relative to mutation |
|---|---|---|---|---|
| CEP290-232 | − | CUUAUCUAAGAUCCUUUCAC (SEQ ID NO: 734) | 20 | upstream |
| CEP290-233 | + | CUUGACUUUUACCCUUC (SEQ ID NO: 649) | 17 | downstream |
| CEP290-234 | + | CUUGUUCUGUCCUCAGUAAA (SEQ ID NO: 728) | 20 | upstream |
| CEP290-235 | + | CUUUUGACAGUUUUUAAGGC (SEQ ID NO: 684) | 20 | downstream |

Table 8C provides targeting domains for break-induced deletion of genomic sequence including the mutation at the LCA10 target position in the CEP290 gene selected according to the third tier parameters. The targeting domains are within 1000 bp upstream of an Alu repeat, within 40 bp upstream of mutation, or 1000 bp downstream of the mutation, and start with G. It is contemplated herein that the targeting domain hybridizes to the target domain through complementary base pairing. Any of the targeting domains in the table can be used with a *S. pyogenes* Cas9 molecule that generates a double stranded break (Cas9 nuclease) or a single-stranded break (Cas9 nickase).

TABLE 8C

| gRNA Name | DNA Strand | Targeting Domain | Target Site Length | Position relative to mutation |
|---|---|---|---|---|
| CEP290-236 | − | GAAAUACAAAAACUGGA (SEQ ID NO: 1148) | 17 | downstream |
| CEP290-237 | + | GCUUUUGACAGUUUUUA (SEQ ID NO: 634) | 17 | downstream |
| CEP290-238 | + | GGAGAUAGAGACAGGAAUAA (SEQ ID NO: 635) | 20 | downstream |
| CEP290-239 | − | GGAGUGCAGUGGAGUGAUCU (SEQ ID NO: 1149) | 20 | downstream |
| CEP290-240 | + | GGGGUAAGAGAAAGGGA (SEQ ID NO: 1150) | 17 | upstream |
| CEP290-241 | + | GGGUAAGAGAAAGGGAU (SEQ ID NO: 1151) | 17 | upstream |
| CEP290-242 | − | GUCUCACUGUGUUGCCC (SEQ ID NO: 1152) | 17 | downstream |
| CEP290-243 | − | GUGCAGUGGAGUGAUCU (SEQ ID NO: 1153) | 17 | downstream |
| CEP290-244 | + | GUGUGUGUGUGUGUUAUG (SEQ ID NO: 1154) | 20 | upstream |
| CEP290-245 | + | GUGUGUGUGUGUUAUGU (SEQ ID NO: 1155) | 17 | upstream |

Table 8D provides targeting domains for break-induced deletion of genomic sequence including the mutation at the LCA10 target position in the CEP290 gene selected according to the fourth tier parameters. The targeting domains are within 1000 bp upstream of an Alu repeat, within 40 bp upstream of mutation, or 1000 bp downstream of the mutation, and do not start with G. It is contemplated herein that the targeting domain hybridizes to the target domain through complementary base pairing. Any of the targeting domains in the table can be used with a *S. pyogenes* Cas9 molecule that generates a double stranded break (Cas9 nuclease) or a single-stranded break (Cas9 nickase).

TABLE 8D

| gRNA Name | DNA Strand | Targeting Domain | Target Site Length | Position relative to mutation |
|---|---|---|---|---|
| CEP290-246 | − | AAAUACAAAAACUGGAU (SEQ ID NO: 1156) | 17 | downstream |
| CEP290-247 | − | AAGCAUACUUUUUUUAA (SEQ ID NO: 667) | 17 | downstream |
| CEP290-248 | + | AAGGCGGGGAGUCACAU (SEQ ID NO: 636) | 17 | downstream |
| CEP290-249 | + | AAGUAUGCUUAAGAAAAAAA (SEQ ID NO: 693) | 20 | downstream |
| CEP290-250 | + | ACAGAGGACAUGGAGAA (SEQ ID NO: 715) | 17 | upstream |
| CEP290-251 | + | ACAGGGGUAAGAGAAAGGGA (SEQ ID NO: 1160) | 20 | upstream |
| CEP290-253 | + | ACUAAGACACUGCCAAU (SEQ ID NO: 603) | 17 | downstream |
| CEP290-254 | + | ACUCCACUGCACUCCAGCCU (SEQ ID NO: 1161) | 20 | downstream |
| CEP290-255 | + | AGACUGGAGAUAGAGAC (SEQ ID NO: 664) | 17 | downstream |
| CEP290-256 | − | AGAGUCUCACUGUGUUGCCC (SEQ ID NO: 1163) | 20 | downstream |
| CEP290-257 | + | AGAUGAAAAAUACUCUU (SEQ ID NO: 718) | 17 | upstream |
| CEP290-258 | − | AUAUUAUCUAUUUAUAG (SEQ ID NO: 1165) | 17 | upstream |
| CEP290-259 | − | AUUUCAUGUGUGAAGAA (SEQ ID NO: 1166) | 17 | downstream |
| CEP290-260 | − | AUUUUUUAUUAUCUUUAUUG (SEQ ID NO: 694) | 20 | downstream |
| CEP290-261 | + | CAACUGGAAGAGAGAAA (SEQ ID NO: 668) | 17 | downstream |
| CEP290-262 | + | CACUCCACUGCACUCCAGCC (SEQ ID NO: 1169) | 20 | downstream |
| CEP290-263 | − | CACUGUGUUGCCCAGGC (SEQ ID NO: 1170) | 17 | downstream |
| CEP290-264 | + | CCAAGGAACAAAAGCCA (SEQ ID NO: 1171) | 17 | upstream |
| CEP290-265 | + | CCACUGCACUCCAGCCU (SEQ ID NO: 1172) | 17 | downstream |
| CEP290-266 | − | CCCAGGCUGGAGUGCAG (SEQ ID NO: 1173) | 17 | downstream |
| CEP290-267 | − | CCCUGGCUUUUGUUCCU (SEQ ID NO: 1174) | 17 | upstream |
| CEP290-268 | + | CGCUUGAACCUGGGAGGCAG (SEQ ID NO: 1175) | 20 | downstream |
| CEP290-269 | − | UAAGGAAAUACAAAAAC (SEQ ID NO: 1176) | 17 | downstream |

TABLE 8D-continued

| gRNA Name | DNA Strand | Targeting Domain | Target Site Length | Position relative to mutation |
|---|---|---|---|---|
| CEP290-270 | − | UAAUAAGGAAAUACAAAAAC (SEQ ID NO: 1177) | 20 | downstream |
| CEP290-271 | − | UACUGCAACCUCUGCCUCCC (SEQ ID NO: 1178) | 20 | downstream |
| CEP290-272 | + | UAUGCUUAAGAAAAAAA (SEQ ID NO: 669) | 17 | downstream |
| CEP290-273 | + | UCAUUCUUGUGGCAGUAAGG (SEQ ID NO: 692) | 20 | downstream |
| CEP290-274 | + | UCCACUGCACUCCAGCC (SEQ ID NO: 1181) | 17 | downstream |
| CEP290-275 | − | UCUCACUGUGUUGCCCAGGC (SEQ ID NO: 1182) | 20 | downstream |
| CEP290-276 | + | UGAACAAGUUUUGAAAC (SEQ ID NO: 659) | 17 | downstream |
| CEP290-277 | − | UGCAACCUCUGCCUCCC (SEQ ID NO: 1184) | 17 | downstream |
| CEP290-278 | + | UGUGUGUGUGUGUGUUAUGU (SEQ ID NO: 1185) | 20 | upstream |
| CEP290-279 | + | UGUGUGUGUGUGUUAUG (SEQ ID NO: 1186) | 17 | upstream |
| CEP290-280 | + | UUCUUGUGGCAGUAAGG (SEQ ID NO: 666) | 17 | downstream |
| CEP290-281 | + | UUGAACCUGGGAGGCAG (SEQ ID NO: 1188) | 17 | downstream |
| CEP290-282 | − | UUGCCCAGGCUGGAGUGCAG (SEQ ID NO: 1189) | 20 | downstream |
| CEP290-283 | − | UUUUAUUAUCUUUAUUG (SEQ ID NO: 670) | 17 | downstream |

Table 9A provides targeting domains for break-induced deletion of genomic sequence including the mutation at the LCA10 target position in the CEP290 gene selected according to the first tier parameters. The targeting domains are within 1000 bp upstream of an Alu repeat, within 40 bp upstream of mutation, or 1000 bp downstream of the mutation, have good orthogonality, start with G and PAM is NNGRRT. It is contemplated herein that the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 9A

| 1st Tier | | | | |
|---|---|---|---|---|
| gRNA Name | DNA Strand | Targeting Domain | Target Site Length | Position relative to mutation |
| CEP290-284 | + | GCUAAAUCAUGCAAGUGACCUAAG (SEQ ID NO: 511) | 24 | upstream |
| CEP290-487 | − | GGUCACUUGCAUGAUUUAG (SEQ ID NO: 512) | 19 | upstream |
| CEP290-486 | − | GUCACUUGCAUGAUUUAG (SEQ ID NO: 513) | 18 | upstream |
| CEP290-285 | + | GCCUAGGACUUUCUAAUGCUGGA (SEQ ID NO: 514) | 23 | upstream |

TABLE 9A-continued

| | | 1st Tier | | |
|---|---|---|---|---|
| gRNA Name | DNA Strand | Targeting Domain | Target Site Length | Position relative to mutation |
| CEP290-479 | + | GGACUUUCUAAUGCUGGA (SEQ ID NO: 515) | 18 | upstream |
| CEP290-286 | + | GGGACCAUGGGAGAAUAGUUUGUU (SEQ ID NO: 516) | 24 | upstream |
| CEP290-287 | + | GGACCAUGGGAGAAUAGUUUGUU (SEQ ID NO: 517) | 23 | upstream |
| CEP290-288 | + | GACCAUGGGAGAAUAGUUUGUU (SEQ ID NO: 518) | 22 | upstream |
| CEP290-289 | − | GGUCCCUGGCUUUUGUUCCUUGGA (SEQ ID NO: 519) | 24 | upstream |
| CEP290-290 | − | GUCCCUGGCUUUUGUUCCUUGGA (SEQ ID NO: 520) | 23 | upstream |
| CEP290-374 | − | GAAAACGUUGUUCUGAGUAGCUUU (SEQ ID NO: 521) | 24 | upstream |
| CEP290-478 | − | GUUGUUCUGAGUAGCUUU (SEQ ID NO: 522) | 18 | upstream |
| CEP290-489 | − | GGUCCCUGGCUUUUGUUCCU (SEQ ID NO: 494) | 20 | upstream |
| CEP290-488 | − | GUCCCUGGCUUUUGUUCCU (SEQ ID NO: 523) | 19 | upstream |
| CEP290-291 | − | GACAUCUUGUGGAUAAUGUAUCA (SEQ ID NO: 524) | 23 | upstream |
| CEP290-292 | − | GUCCUAGGCAAGAGACAUCUU (SEQ ID NO: 525) | 21 | upstream |
| CEP290-293 | + | GCCAGCAAAAGCUUUUGAGCUAA (SEQ ID NO: 526) | 23 | upstream |
| CEP290-481 | + | GCAAAAGCUUUUGAGCUAA (SEQ ID NO: 527) | 19 | upstream |
| CEP290-294 | + | GAUCUUAUUCUACUCCUGUGA (SEQ ID NO: 528) | 21 | upstream |
| CEP290-295 | − | GCUUUCAGGAUUCCUACUAAAUU (SEQ ID NO: 529) | 23 | upstream |
| CEP290-323 | + | GUUCUGUCCUCAGUAAAAGGUA (SEQ ID NO: 530) | 22 | upstream |
| CEP290-480 | + | GAACAACGUUUUCAUUUA (SEQ ID NO: 531) | 18 | upstream |
| CEP290-296 | − | GUAGAAUAUCAUAAGUUACAAUCU (SEQ ID NO: 532) | 24 | upstream |
| CEP290-297 | − | GAAUAUCAUAAGUUACAAUCU (SEQ ID NO: 533) | 21 | upstream |
| CEP290-298 | + | GUGGCUGUAAGAUAACUACA (SEQ ID NO: 534) | 20 | upstream |
| CEP290-299 | + | GGCUGUAAGAUAACUACA (SEQ ID NO: 535) | 18 | upstream |
| CEP290-300 | − | GUUUAACGUUAUCAUUUUCCCA (SEQ ID NO: 536) | 22 | upstream |
| CEP290-301 | + | GUAAGAGAAAGGGAUGGGCACUUA (SEQ ID NO: 537) | 24 | upstream |

TABLE 9A-continued

1st Tier

| gRNA Name | DNA Strand | Targeting Domain | Target Site Length | Position relative to mutation |
|---|---|---|---|---|
| CEP290-492 | + | GAGAAAGGGAUGGGCACUUA (SEQ ID NO: 538) | 20 | upstream |
| CEP290-491 | + | GAAAGGGAUGGGCACUUA (SEQ ID NO: 539) | 18 | upstream |
| CEP290-483 | − | GUAAAUGAAAACGUUGUU (SEQ ID NO: 540) | 18 | upstream |
| CEP290-302 | + | GAUAAACAUGACUCAUAAUUUAGU (SEQ ID NO: 541) | 24 | upstream |
| CEP290-303 | + | GGAACAAAAGCCAGGGACCAUGG (SEQ ID NO: 542) | 23 | upstream |
| CEP290-304 | + | GAACAAAAGCCAGGGACCAUGG (SEQ ID NO: 543) | 22 | upstream |
| CEP290-305 | + | GGGAGAAUAGUUUGUUCUGGGUAC (SEQ ID NO: 544) | 24 | upstream |
| CEP290-306 | + | GGAGAAUAGUUUGUUCUGGGUAC (SEQ ID NO: 545) | 23 | upstream |
| CEP290-307 | + | GAGAAUAGUUUGUUCUGGGUAC (SEQ ID NO: 546) | 22 | upstream |
| CEP290-490 | + | GAAUAGUUUGUUCUGGGUAC (SEQ ID NO: 468) | 20 | upstream |
| CEP290-482 | − | GAAAUAGAGGCUUAUGGAUU (SEQ ID NO: 547) | 20 | upstream |
| CEP290-308 | + | GUUCUGGGUACAGGGGUAAGAGAA (SEQ ID NO: 548) | 24 | upstream |
| CEP290-494 | + | GGGUACAGGGGUAAGAGAA (SEQ ID NO: 549) | 19 | upstream |
| CEP290-493 | + | GGUACAGGGGUAAGAGAA (SEQ ID NO: 550) | 18 | upstream |
| CEP290-309 | − | GUAAAUUCUCAUCAUUUUUAUUG (SEQ ID NO: 551) | 24 | upstream |
| CEP290-310 | + | GGAGAGGAUAGGACAGAGGACAUG (SEQ ID NO: 552) | 24 | upstream |
| CEP290-311 | + | GAGAGGAUAGGACAGAGGACAUG (SEQ ID NO: 553) | 23 | upstream |
| CEP290-313 | + | GAGGAUAGGACAGAGGACAUG (SEQ ID NO: 554) | 21 | upstream |
| CEP290-485 | + | GGAUAGGACAGAGGACAUG (SEQ ID NO: 555) | 19 | upstream |
| CEP290-484 | + | GAUAGGACAGAGGACAUG (SEQ ID NO: 556) | 18 | upstream |
| CEP290-314 | − | GAAUAAAUGUAGAAUUUUAAUG (SEQ ID NO: 557) | 22 | upstream |
| CEP290-64 | − | GUCAAAAGCUACCGGUUACCUG (SEQ ID NO: 558) | 22 | downstream |
| CEP290-315 | + | GUUUUUAAGGCGGGGAGUCACAU (SEQ ID NO: 559) | 23 | downstream |
| CEP290-203 | − | GUCUUACAUCCUCCUUACUGCCAC (SEQ ID NO: 560) | 24 | downstream |

TABLE 9A-continued

| | | 1st Tier | | |
|---|---|---|---|---|
| gRNA Name | DNA Strand | Targeting Domain | Target Site Length | Position relative to mutation |
| CEP290-316 | + | GAGUCACAGGGUAGGAUUCAUGUU (SEQ ID NO: 561) | 24 | downstream |
| CEP290-317 | + | GUCACAGGGUAGGAUUCAUGUU (SEQ ID NO: 562) | 22 | downstream |
| CEP290-318 | − | GGCACAGAGUUCAAGCUAAUACAU (SEQ ID NO: 563) | 24 | downstream |
| CEP290-319 | − | GCACAGAGUUCAAGCUAAUACAU (SEQ ID NO: 564) | 23 | downstream |
| CEP290-505 | − | GAGUUCAAGCUAAUACAU (SEQ ID NO: 565) | 18 | downstream |
| CEP290-496 | + | GAUGCAGAACUAGUGUAGAC (SEQ ID NO: 460) | 20 | downstream |
| CEP290-320 | − | GUGUUGAGUAUCUCCUGUUUGGCA (SEQ ID NO: 566) | 24 | downstream |
| CEP290-321 | − | GUUGAGUAUCUCCUGUUUGGCA (SEQ ID NO: 567) | 22 | downstream |
| CEP290-504 | − | GAGUAUCUCCUGUUUGGCA (SEQ ID NO: 568) | 19 | downstream |
| CEP290-322 | − | GAAAAUCAGAUUUCAUGUGUG (SEQ ID NO: 569) | 21 | downstream |
| CEP290-324 | − | GCCACAAGAAUGAUCAUUCUAAAC (SEQ ID NO: 570) | 24 | downstream |
| CEP290-325 | + | GGCGGGGAGUCACAUGGGAGUCA (SEQ ID NO: 571) | 23 | downstream |
| CEP290-326 | + | GCGGGGAGUCACAUGGGAGUCA (SEQ ID NO: 572) | 22 | downstream |
| CEP290-499 | + | GGGGAGUCACAUGGGAGUCA (SEQ ID NO: 573) | 20 | downstream |
| CEP290-498 | + | GGGAGUCACAUGGGAGUCA (SEQ ID NO: 574) | 19 | downstream |
| CEP290-497 | + | GGAGUCACAUGGGAGUCA (SEQ ID NO: 575) | 18 | downstream |
| CEP290-327 | + | GCUUUUGACAGUUUUUAAGGCG (SEQ ID NO: 576) | 22 | downstream |
| CEP290-328 | + | GAUCAUUCUUGUGGCAGUAAG (SEQ ID NO: 577) | 21 | downstream |
| CEP290-329 | − | GAGCAAGAGAUGAACUAG (SEQ ID NO: 578) | 18 | downstream |
| CEP290-500 | + | GCCUGAACAAGUUUUGAAAC (SEQ ID NO: 480) | 20 | downstream |
| CEP290-330 | − | GUAGAUUGAGGUAGAAUCAAGAA (SEQ ID NO: 579) | 23 | downstream |
| CEP290-506 | − | GAUUGAGGUAGAAUCAAGAA (SEQ ID NO: 580) | 20 | downstream |
| CEP290-331 | + | GGAUGUAAGACUGGAGAUAGAGAC (SEQ ID NO: 581) | 24 | downstream |
| CEP290-332 | + | GAUGUAAGACUGGAGAUAGAGAC (SEQ ID NO: 582) | 23 | downstream |

TABLE 9A-continued

1st Tier

| gRNA Name | DNA Strand | Targeting Domain | Target Site Length | Position relative to mutation |
|---|---|---|---|---|
| CEP290-503 | + | GUAAGACUGGAGAUAGAGAC (SEQ ID NO: 497) | 20 | downstream |
| CEP290-333 | + | GGGAGUCACAUGGGAGUCACAGGG (SEQ ID NO: 583) | 24 | downstream |
| CEP290-334 | + | GGAGUCACAUGGGAGUCACAGGG (SEQ ID NO: 584) | 23 | downstream |
| CEP290-335 | + | GAGUCACAUGGGAGUCACAGGG (SEQ ID NO: 585) | 22 | downstream |
| CEP290-502 | + | GUCACAUGGGAGUCACAGGG (SEQ ID NO: 586) | 20 | downstream |
| CEP290-336 | − | GUUUACAUAUCUGUCUUCCUUAA (SEQ ID NO: 587) | 23 | downstream |
| CEP290-507 | − | GAUUUCAUGUGUGAAGAA (SEQ ID NO: 588) | 18 | downstream |

Table 9B provides targeting domains for break-induced deletion of genomic sequence including the mutation at the LCA10 target position in the CEP290 gene selected according to the second tier parameters. The targeting domains are within 1000 bp upstream of an Alu repeat, within 40 bp upstream of mutation, or 1000 bp downstream of the mutation, and have good orthogonality. It is contemplated herein that the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 9B

| gRNA Name | DNA Strand | Targeting Domain | Target Site Length | Position relative to mutation |
|---|---|---|---|---|
| CEP290-337 | + | AAAUCAUGCAAGUGACCUAAG (SEQ ID NO: 1191) | 21 | upstream |
| CEP290-338 | + | AAUCAUGCAAGUGACCUAAG (SEQ ID NO: 1192) | 20 | upstream |
| CEP290-339 | + | AUCAUGCAAGUGACCUAAG (SEQ ID NO: 1193) | 19 | upstream |
| CEP290-340 | − | AGGUCACUUGCAUGAUUUAG (SEQ ID NO: 1194) | 20 | upstream |
| CEP290-341 | − | AAUAUUAAGGGCUCUUCCUGGACC (SEQ ID NO: 1195) | 24 | upstream |
| CEP290-342 | − | AUAUUAAGGGCUCUUCCUGGACC (SEQ ID NO: 1196) | 23 | upstream |
| CEP290-343 | − | AUUAAGGGCUCUUCCUGGACC (SEQ ID NO: 1197) | 21 | upstream |
| CEP290-344 | − | AAGGGCUCUUCCUGGACC (SEQ ID NO: 1198) | 18 | upstream |
| CEP290-345 | + | AGGACUUUCUAAUGCUGGA (SEQ ID NO: 1199) | 19 | upstream |
| CEP290-346 | + | ACCAUGGGAGAAUAGUUUGUU (SEQ ID NO: 1200) | 21 | upstream |
| CEP290-347 | + | AUGGGAGAAUAGUUUGUU (SEQ ID NO: 1201) | 18 | upstream |
| CEP290-348 | + | ACUCCUGUGAAAGGAUCUUAGAU (SEQ ID NO: 1202) | 23 | upstream |

TABLE 9B-continued

| gRNA Name | DNA Strand | Targeting Domain | Target Site Length | Position relative to mutation |
|---|---|---|---|---|
| CEP290-349 | - | AAAACGUUGUUCUGAGUAGCUUU (SEQ ID NO: 1203) | 23 | upstream |
| CEP290-350 | - | AAACGUUGUUCUGAGUAGCUUU (SEQ ID NO: 1204) | 22 | upstream |
| CEP290-351 | - | AACGUUGUUCUGAGUAGCUUU (SEQ ID NO: 1205) | 21 | upstream |
| CEP290-352 | - | ACGUUGUUCUGAGUAGCUUU (SEQ ID NO: 749) | 20 | upstream |
| CEP290-353 | - | AUUUAUAGUGGCUGAAUGACUU (SEQ ID NO: 1207) | 22 | upstream |
| CEP290-354 | - | AUAGUGGCUGAAUGACUU (SEQ ID NO: 1208) | 18 | upstream |
| CEP290-355 | - | AUGGUCCCUGGCUUUUGUUCCU (SEQ ID NO: 1209) | 22 | upstream |
| CEP290-356 | - | AGACAUCUUGUGGAUAAUGUAUCA (SEQ ID NO: 1210) | 24 | upstream |
| CEP290-357 | - | ACAUCUUGUGGAUAAUGUAUCA (SEQ ID NO: 1211) | 22 | upstream |
| CEP290-358 | - | AUCUUGUGGAUAAUGUAUCA (SEQ ID NO: 835) | 20 | upstream |
| CEP290-359 | - | AAAGUCCUAGGCAAGAGACAUCUU (SEQ ID NO: 1213) | 24 | upstream |
| CEP290-360 | - | AAGUCCUAGGCAAGAGACAUCUU (SEQ ID NO: 1214) | 23 | upstream |
| CEP290-361 | - | AGUCCUAGGCAAGAGACAUCUU (SEQ ID NO: 1215) | 22 | upstream |
| CEP290-362 | + | AGCCAGCAAAAGCUUUUGAGCUAA (SEQ ID NO: 1216) | 24 | upstream |
| CEP290-363 | + | AGCAAAAGCUUUUGAGCUAA (SEQ ID NO: 763) | 20 | upstream |
| CEP290-364 | + | AGAUCUUAUUCUACUCCUGUGA (SEQ ID NO: 1218) | 22 | upstream |
| CEP290-365 | + | AUCUUAUUCUACUCCUGUGA (SEQ ID NO: 764) | 20 | upstream |
| CEP290-366 | - | AUCUAAGAUCCUUUCACAGGAG (SEQ ID NO: 1220) | 22 | upstream |
| CEP290-369 | - | AAGAUCCUUUCACAGGAG (SEQ ID NO: 1221) | 18 | upstream |
| CEP290-370 | - | AGCUUUCAGGAUUCCUACUAAAUU (SEQ ID NO: 1222) | 24 | upstream |
| CEP290-371 | + | ACUCAGAACAACGUUUUCAUUUA (SEQ ID NO: 1223) | 23 | upstream |
| CEP290-372 | + | AGAACAACGUUUUCAUUUA (SEQ ID NO: 1224) | 19 | upstream |
| CEP290-373 | - | AGAAUAUCAUAAGUUACAAUCU (SEQ ID NO: 1225) | 22 | upstream |
| CEP290-375 | - | AAUAUCAUAAGUUACAAUCU (SEQ ID NO: 1226) | 20 | upstream |
| CEP290-376 | - | AUAUCAUAAGUUACAAUCU (SEQ ID NO: 1227) | 19 | upstream |

TABLE 9B-continued

| gRNA Name | DNA Strand | Targeting Domain | Target Site Length | Position relative to mutation |
|---|---|---|---|---|
| CEP290-377 | + | AAGUGGCUGUAAGAUAACUACA (SEQ ID NO: 1228) | 22 | upstream |
| CEP290-378 | + | AGUGGCUGUAAGAUAACUACA (SEQ ID NO: 1229) | 21 | upstream |
| CEP290-379 | − | AUGUUUAACGUUAUCAUUUCCCA (SEQ ID NO: 1230) | 24 | upstream |
| CEP290-380 | − | AACGUUAUCAUUUCCCA (SEQ ID NO: 1231) | 18 | upstream |
| CEP290-381 | + | AAGAGAAAGGGAUGGGCACUUA (SEQ ID NO: 1232) | 22 | upstream |
| CEP290-382 | + | AGAGAAAGGGAUGGGCACUUA (SEQ ID NO: 1233) | 21 | upstream |
| CEP290-383 | + | AGAAAGGGAUGGGCACUUA (SEQ ID NO: 1234) | 19 | upstream |
| CEP290-384 | − | AUUCAGUAAAUGAAAACGUUGUU (SEQ ID NO: 1235) | 23 | upstream |
| CEP290-385 | − | AGUAAAUGAAAACGUUGUU (SEQ ID NO: 1236) | 19 | upstream |
| CEP290-386 | + | AUAAACAUGACUCAUAAUUUAGU (SEQ ID NO: 1237) | 23 | upstream |
| CEP290-387 | + | AAACAUGACUCAUAAUUUAGU (SEQ ID NO: 1238) | 21 | upstream |
| CEP290-388 | + | AACAUGACUCAUAAUUUAGU (SEQ ID NO: 721) | 20 | upstream |
| CEP290-389 | + | ACAUGACUCAUAAUUUAGU (SEQ ID NO: 1240) | 19 | upstream |
| CEP290-390 | − | AUUCUUAUCUAAGAUCCUUUCAC (SEQ ID NO: 1241) | 23 | upstream |
| CEP290-391 | + | AGGAACAAAAGCCAGGGACCAUGG (SEQ ID NO: 1242) | 24 | upstream |
| CEP290-392 | + | AACAAAAGCCAGGGACCAUGG (SEQ ID NO: 1243) | 21 | upstream |
| CEP290-393 | + | ACAAAAGCCAGGGACCAUGG (SEQ ID NO: 1244) | 20 | upstream |
| CEP290-394 | + | AAAAGCCAGGGACCAUGG (SEQ ID NO: 1245) | 18 | upstream |
| CEP290-395 | + | AGAAUAGUUUGUUCUGGGUAC (SEQ ID NO: 1246) | 21 | upstream |
| CEP290-396 | + | AAUAGUUUGUUCUGGGUAC (SEQ ID NO: 1247) | 19 | upstream |
| CEP290-397 | + | AUAGUUUGUUCUGGGUAC (SEQ ID NO: 1248) | 18 | upstream |
| CEP290-398 | − | AUCAGAAAUAGAGGCUUAUGGAUU (SEQ ID NO: 1249) | 24 | upstream |
| CEP290-399 | − | AGAAAUAGAGGCUUAUGGAUU (SEQ ID NO: 1250) | 21 | upstream |
| CEP290-400 | − | AAAUAGAGGCUUAUGGAUU (SEQ ID NO: 1251) | 19 | upstream |

TABLE 9B-continued

| gRNA Name | DNA Strand | Targeting Domain | Target Site Length | Position relative to mutation |
|---|---|---|---|---|
| CEP290-401 | − | AAUAGAGGCUUAUGGAUU (SEQ ID NO: 1252) | 18 | upstream |
| CEP290-402 | − | AAUAUAUUAUCUAUUUAUAGUGG (SEQ ID NO: 1253) | 23 | upstream |
| CEP290-403 | − | AUAUAUUAUCUAUUUAUAGUGG (SEQ ID NO: 1254) | 22 | upstream |
| CEP290-404 | − | AUAUUAUCUAUUUAUAGUGG (SEQ ID NO: 1255) | 20 | upstream |
| CEP290-405 | − | AUUAUCUAUUUAUAGUGG (SEQ ID NO: 1256) | 18 | upstream |
| CEP290-406 | − | AAAUUCUCAUCAUUUUUUAUUG (SEQ ID NO: 1257) | 22 | upstream |
| CEP290-407 | − | AAUUCUCAUCAUUUUUUAUUG (SEQ ID NO: 1258) | 21 | upstream |
| CEP290-408 | − | AUUCUCAUCAUUUUUUAUUG (SEQ ID NO: 1259) | 20 | upstream |
| CEP290-409 | + | AGAGGAUAGGACAGAGGACAUG (SEQ ID NO: 1260) | 22 | upstream |
| CEP290-410 | + | AGGAUAGGACAGAGGACAUG (SEQ ID NO: 827) | 20 | upstream |
| CEP290-411 | − | AGAAUAAAUGUAGAAUUUUAAUG (SEQ ID NO: 1262) | 23 | upstream |
| CEP290-412 | − | AAUAAAUGUAGAAUUUUAAUG (SEQ ID NO: 1263) | 21 | upstream |
| CEP290-413 | − | AUAAAUGUAGAAUUUUAAUG (SEQ ID NO: 1264) | 20 | upstream |
| CEP290-414 | − | AAAUGUAGAAUUUUAAUG (SEQ ID NO: 1265) | 18 | upstream |
| CEP290-415 | − | AUUUUUUAUUGUAGAAUAAAUG (SEQ ID NO: 1266) | 22 | upstream |
| CEP290-416 | + | CUAAAUCAUGCAAGUGACCUAAG (SEQ ID NO: 1267) | 23 | upstream |
| CEP290-417 | − | CCUUAGGUCACUUGCAUGAUUUAG (SEQ ID NO: 1268) | 24 | upstream |
| CEP290-418 | − | CUUAGGUCACUUGCAUGAUUUAG (SEQ ID NO: 1269) | 23 | upstream |
| CEP290-419 | + | CCUAGGACUUUCUAAUGCUGGA (SEQ ID NO: 1270) | 22 | upstream |
| CEP290-420 | + | CUAGGACUUUCUAAUGCUGGA (SEQ ID NO: 1271) | 21 | upstream |
| CEP290-421 | + | CCAUGGGAGAAUAGUUUGUU (SEQ ID NO: 1272) | 20 | upstream |
| CEP290-422 | + | CAUGGGAGAAUAGUUUGUU (SEQ ID NO: 1273) | 19 | upstream |
| CEP290-423 | + | CUCCUGUGAAAGGAUCUUAGAU (SEQ ID NO: 1274) | 22 | upstream |
| CEP290-424 | + | CCUGUGAAAGGAUCUUAGAU (SEQ ID NO: 860) | 20 | upstream |
| CEP290-426 | + | CUGUGAAAGGAUCUUAGAU (SEQ ID NO: 1276) | 19 | upstream |

TABLE 9B-continued

| gRNA Name | DNA Strand | Targeting Domain | Target Site Length | Position relative to mutation |
|---|---|---|---|---|
| CEP290-427 | − | CCCUGGCUUUUGUUCCUUGGA (SEQ ID NO: 1277) | 21 | upstream |
| CEP290-428 | − | CCUGGCUUUUGUUCCUUGGA (SEQ ID NO: 1278) | 20 | upstream |
| CEP290-429 | − | CUGGCUUUUGUUCCUUGGA (SEQ ID NO: 1279) | 19 | upstream |
| CEP290-430 | − | CGUUGUUCUGAGUAGCUUU (SEQ ID NO: 1280) | 19 | upstream |
| CEP290-431 | − | CUAUUUAUAGUGGCUGAAUGACUU (SEQ ID NO: 1281) | 24 | upstream |
| CEP290-432 | − | CCAUGGUCCCUGGCUUUUGUUCCU (SEQ ID NO: 1282) | 24 | upstream |
| CEP290-433 | − | CAUGGUCCCUGGCUUUUGUUCCU (SEQ ID NO: 1283) | 23 | upstream |
| CEP290-434 | − | CAUCUUGUGGAUAAUGUAUCA (SEQ ID NO: 1284) | 21 | upstream |
| CEP290-435 | − | CUUGUGGAUAAUGUAUCA (SEQ ID NO: 1285) | 18 | upstream |
| CEP290-437 | − | CCUAGGCAAGAGACAUCUU (SEQ ID NO: 1286) | 19 | upstream |
| CEP290-438 | − | CUAGGCAAGAGACAUCUU (SEQ ID NO: 1287) | 18 | upstream |
| CEP290-439 | + | CCAGCAAAAGCUUUUGAGCUAA (SEQ ID NO: 1288) | 22 | upstream |
| CEP290-440 | + | CAGCAAAAGCUUUUGAGCUAA (SEQ ID NO: 1289) | 21 | upstream |
| CEP290-441 | + | CAAAAGCUUUUGAGCUAA (SEQ ID NO: 1290) | 18 | upstream |
| CEP290-442 | + | CUUAUUCUACUCCUGUGA (SEQ ID NO: 1291) | 18 | upstream |
| CEP290-443 | − | CUAAGAUCCUUUCACAGGAG (SEQ ID NO: 861) | 20 | upstream |
| CEP290-444 | − | CUUCCUCAUCAGAAAUAGAGGCUU (SEQ ID NO: 1293) | 24 | upstream |
| CEP290-445 | − | CCUCAUCAGAAAUAGAGGCUU (SEQ ID NO: 1294) | 21 | upstream |
| CEP290-446 | − | CUCAUCAGAAAUAGAGGCUU (SEQ ID NO: 865) | 20 | upstream |
| CEP290-447 | − | CAUCAGAAAUAGAGGCUU (SEQ ID NO: 1296) | 18 | upstream |
| CEP290-448 | − | CUUUCAGGAUUCCUACUAAAUU (SEQ ID NO: 1297) | 22 | upstream |
| CEP290-449 | − | CAGGAUUCCUACUAAAUU (SEQ ID NO: 1298) | 18 | upstream |
| CEP290-450 | + | CUGUCCUCAGUAAAAGGUA (SEQ ID NO: 1299) | 19 | upstream |
| CEP290-451 | + | CUCAGAACAACGUUUUCAUUUA (SEQ ID NO: 1300) | 22 | upstream |
| CEP290-452 | + | CAGAACAACGUUUUCAUUUA (SEQ ID NO: 761) | 20 | upstream |

TABLE 9B-continued

| gRNA Name | DNA Strand | Targeting Domain | Target Site Length | Position relative to mutation |
|---|---|---|---|---|
| CEP290-453 | + | CAAGUGGCUGUAAGAUAACUACA (SEQ ID NO: 1302) | 23 | upstream |
| CEP290-454 | - | CAUUCAGUAAAUGAAAACGUUGUU (SEQ ID NO: 1303) | 24 | upstream |
| CEP290-457 | - | CAGUAAAUGAAAACGUUGUU (SEQ ID NO: 849) | 20 | upstream |
| CEP290-458 | + | CAUGACUCAUAAUUUAGU (SEQ ID NO: 1305) | 18 | upstream |
| CEP290-459 | - | CUUAUCUAAGAUCCUUUCAC (SEQ ID NO: 734) | 20 | upstream |
| CEP290-460 | + | CAAAAGCCAGGGACCAUGG (SEQ ID NO: 1307) | 19 | upstream |
| CEP290-461 | - | CAGAAAUAGAGGCUUAUGGAUU (SEQ ID NO: 1308) | 22 | upstream |
| CEP290-462 | + | CUGGGUACAGGGGUAAGAGAA (SEQ ID NO: 1309) | 21 | upstream |
| CEP290-463 | - | CAAUAUAUUAUCUAUUUAUAGUGG (SEQ ID NO: 1310) | 24 | upstream |
| CEP290-464 | - | CAUUUUUUAUUGUAGAAUAAAUG (SEQ ID NO: 1311) | 23 | upstream |
| CEP290-465 | + | UAAAUCAUGCAAGUGACCUAAG (SEQ ID NO: 1312) | 22 | upstream |
| CEP290-466 | + | UCAUGCAAGUGACCUAAG (SEQ ID NO: 1313) | 18 | upstream |
| CEP290-467 | - | UUAGGUCACUUGCAUGAUUUAG (SEQ ID NO: 1314) | 22 | upstream |
| CEP290-468 | - | UAGGUCACUUGCAUGAUUUAG (SEQ ID NO: 1315) | 21 | upstream |
| CEP290-469 | - | UAUUAAGGGCUCUUCCUGGACC (SEQ ID NO: 1316) | 22 | upstream |
| CEP290-470 | - | UUAAGGGCUCUUCCUGGACC (SEQ ID NO: 1317) | 20 | upstream |
| CEP290-471 | - | UAAGGGCUCUUCCUGGACC (SEQ ID NO: 1318) | 19 | upstream |
| CEP290-472 | + | UGCCUAGGACUUUCUAAUGCUGGA (SEQ ID NO: 1319) | 24 | upstream |
| CEP290-473 | + | UAGGACUUUCUAAUGCUGGA (SEQ ID NO: 882) | 20 | upstream |
| CEP290-474 | + | UACUCCUGUGAAAGGAUCUUAGAU (SEQ ID NO: 1321) | 24 | upstream |
| CEP290-475 | + | UCCUGUGAAAGGAUCUUAGAU (SEQ ID NO: 1322) | 21 | upstream |
| CEP290-476 | + | UGUGAAAGGAUCUUAGAU (SEQ ID NO: 1323) | 18 | upstream |
| CEP290-477 | - | UCCCUGGCUUUUGUUCCUUGGA (SEQ ID NO: 1324) | 22 | upstream |
| CEP290-515 | - | UGGCUUUUGUUCCUUGGA (SEQ ID NO: 1325) | 18 | upstream |
| CEP290-516 | - | UAUUUAUAGUGGCUGAAUGACUU (SEQ ID NO: 1326) | 23 | upstream |

TABLE 9B-continued

| gRNA Name | DNA Strand | Targeting Domain | Target Site Length | Position relative to mutation |
|---|---|---|---|---|
| CEP290-517 | − | UUUAUAGUGGCUGAAUGACUU (SEQ ID NO: 1327) | 21 | upstream |
| CEP290-518 | − | UUAUAGUGGCUGAAUGACUU (SEQ ID NO: 1328) | 20 | upstream |
| CEP290-519 | − | UAUAGUGGCUGAAUGACUU (SEQ ID NO: 1329) | 19 | upstream |
| CEP290-520 | − | UGGUCCCUGGCUUUUGUUCCU (SEQ ID NO: 1330) | 21 | upstream |
| CEP290-521 | − | UCCCUGGCUUUUGUUCCU (SEQ ID NO: 1331) | 18 | upstream |
| CEP290-522 | − | UCUUGUGGAUAAUGUAUCA (SEQ ID NO: 1332) | 19 | upstream |
| CEP290-523 | − | UCCUAGGCAAGAGACAUCUU (SEQ ID NO: 887) | 20 | upstream |
| CEP290-524 | + | UUAGAUCUUAUUCUACUCCUGUGA (SEQ ID NO: 1334) | 24 | upstream |
| CEP290-525 | + | UAGAUCUUAUUCUACUCCUGUGA (SEQ ID NO: 1335) | 23 | upstream |
| CEP290-526 | + | UCUUAUUCUACUCCUGUGA (SEQ ID NO: 1336) | 19 | upstream |
| CEP290-527 | − | UUAUCUAAGAUCCUUUCACAGGAG (SEQ ID NO: 1337) | 24 | upstream |
| CEP290-528 | − | UAUCUAAGAUCCUUUCACAGGAG (SEQ ID NO: 1338) | 23 | upstream |
| CEP290-529 | − | UCUAAGAUCCUUUCACAGGAG (SEQ ID NO: 1339) | 21 | upstream |
| CEP290-530 | − | UAAGAUCCUUUCACAGGAG (SEQ ID NO: 1340) | 19 | upstream |
| CEP290-531 | − | UUCCUCAUCAGAAAUAGAGGCUU (SEQ ID NO: 1341) | 23 | upstream |
| CEP290-532 | − | UCCUCAUCAGAAAUAGAGGCUU (SEQ ID NO: 1342) | 22 | upstream |
| CEP290-533 | − | UCAUCAGAAAUAGAGGCUU (SEQ ID NO: 1343) | 19 | upstream |
| CEP290-534 | − | UUUCAGGAUUCCUACUAAAUU (SEQ ID NO: 1344) | 21 | upstream |
| CEP290-535 | − | UUCAGGAUUCCUACUAAAUU (SEQ ID NO: 904) | 20 | upstream |
| CEP290-536 | − | UCAGGAUUCCUACUAAAUU (SEQ ID NO: 1346) | 19 | upstream |
| CEP290-537 | + | UUGUUCUGUCCUCAGUAAAAGGUA (SEQ ID NO: 1347) | 24 | upstream |
| CEP290-538 | + | UGUUCUGUCCUCAGUAAAAGGUA (SEQ ID NO: 1348) | 23 | upstream |
| CEP290-539 | + | UUCUGUCCUCAGUAAAAGGUA (SEQ ID NO: 1349) | 21 | upstream |
| CEP290-540 | + | UCUGUCCUCAGUAAAAGGUA (SEQ ID NO: 890) | 20 | upstream |
| CEP290-541 | + | UGUCCUCAGUAAAAGGUA (SEQ ID NO: 1351) | 18 | upstream |

TABLE 9B-continued

| gRNA Name | DNA Strand | Targeting Domain | Target Length | Position Site relative to mutation |
|---|---|---|---|---|
| CEP290-542 | + | UACUCAGAACAACGUUUUCAUUUA (SEQ ID NO: 1352) | 24 | upstream |
| CEP290-543 | + | UCAGAACAACGUUUUCAUUUA (SEQ ID NO: 1353) | 21 | upstream |
| CEP290-544 | − | UAGAAUAUCAUAAGUUACAAUCU (SEQ ID NO: 1354) | 23 | upstream |
| CEP290-545 | − | UAUCAUAAGUUACAAUCU (SEQ ID NO: 1355) | 18 | upstream |
| CEP290-546 | + | UCAAGUGGCUGUAAGAUAACUACA (SEQ ID NO: 1356) | 24 | upstream |
| CEP290-547 | + | UGGCUGUAAGAUAACUACA (SEQ ID NO: 1357) | 19 | upstream |
| CEP290-548 | − | UGUUUAACGUUAUCAUUUCCCA (SEQ ID NO: 1358) | 23 | upstream |
| CEP290-549 | − | UUUAACGUUAUCAUUUCCCA (SEQ ID NO: 1359) | 21 | upstream |
| CEP290-550 | − | UUAACGUUAUCAUUUCCCA (SEQ ID NO: 900) | 20 | upstream |
| CEP290-551 | − | UAACGUUAUCAUUUCCCA (SEQ ID NO: 1361) | 19 | upstream |
| CEP290-552 | + | UAAGAGAAAGGGAUGGGCACUUA (SEQ ID NO: 1362) | 23 | upstream |
| CEP290-553 | − | UUCAGUAAAUGAAAACGUUGUU (SEQ ID NO: 1363) | 22 | upstream |
| CEP290-554 | − | UCAGUAAAUGAAAACGUUGUU (SEQ ID NO: 1364) | 21 | upstream |
| CEP290-555 | + | UAAACAUGACUCAUAAUUUAGU (SEQ ID NO: 1365) | 22 | upstream |
| CEP290-556 | − | UAUUCUUAUCUAAGAUCCUUUCAC (SEQ ID NO: 1366) | 24 | upstream |
| CEP290-557 | − | UUCUUAUCUAAGAUCCUUUCAC (SEQ ID NO: 1367) | 22 | upstream |
| CEP290-558 | − | UCUUAUCUAAGAUCCUUUCAC (SEQ ID NO: 1368) | 21 | upstream |
| CEP290-559 | − | UUAUCUAAGAUCCUUUCAC (SEQ ID NO: 1369) | 19 | upstream |
| CEP290-560 | − | UAUCUAAGAUCCUUUCAC (SEQ ID NO: 1370) | 18 | upstream |
| CEP290-561 | − | UCAGAAAUAGAGGCUUAUGGAUU (SEQ ID NO: 1371) | 23 | upstream |
| CEP290-562 | + | UUCUGGGUACAGGGGUAAGAGAA (SEQ ID NO: 1372) | 23 | upstream |
| CEP290-563 | + | UCUGGGUACAGGGGUAAGAGAA (SEQ ID NO: 1373) | 22 | upstream |
| CEP290-564 | + | UGGGUACAGGGGUAAGAGAA (SEQ ID NO: 1374) | 20 | upstream |
| CEP290-565 | − | UAUAUUAUCUAUUUAUAGUGG (SEQ ID NO: 1375) | 21 | upstream |
| CEP290-566 | − | UAUUAUCUAUUUAUAGUGG (SEQ ID NO: 1376) | 19 | upstream |

TABLE 9B-continued

| gRNA Name | DNA Strand | Targeting Domain | Target Site Length | Position relative to mutation |
|---|---|---|---|---|
| CEP290-567 | − | UAAAUUCUCAUCAUUUUUAUUG (SEQ ID NO: 1377) | 23 | upstream |
| CEP290-568 | − | UUCUCAUCAUUUUUAUUG (SEQ ID NO: 1378) | 19 | upstream |
| CEP290-569 | − | UCUCAUCAUUUUUAUUG (SEQ ID NO: 1379) | 18 | upstream |
| CEP290-570 | − | UAGAAUAAAUGUAGAAUUUUAAUG (SEQ ID NO: 1380) | 24 | upstream |
| CEP290-571 | − | UAAAUGUAGAAUUUUAAUG (SEQ ID NO: 1381) | 19 | upstream |
| CEP290-572 | − | UCAUUUUUAUUGUAGAAUAAAUG (SEQ ID NO: 1382) | 24 | upstream |
| CEP290-573 | − | UUUUUUAUUGUAGAAUAAAUG (SEQ ID NO: 1383) | 21 | upstream |
| CEP290-574 | − | UUUUUAUUGUAGAAUAAAUG (SEQ ID NO: 1384) | 20 | upstream |
| CEP290-575 | − | UUUUAUUGUAGAAUAAAUG (SEQ ID NO: 1385) | 19 | upstream |
| CEP290-576 | − | UUUAUUGUAGAAUAAAUG (SEQ ID NO: 1386) | 18 | upstream |
| CEP290-577 | − | AAAAGCUACCGGUUACCUG (SEQ ID NO: 1387) | 19 | downstream |
| CEP290-578 | − | AAAGCUACCGGUUACCUG (SEQ ID NO: 1388) | 18 | downstream |
| CEP290-579 | + | AGUUUUUAAGGCGGGGAGUCACAU (SEQ ID NO: 1389) | 24 | downstream |
| CEP290-580 | − | ACAUCCUCCUUACUGCCAC (SEQ ID NO: 1390) | 19 | downstream |
| CEP290-581 | + | AGUCACAGGGUAGGAUUCAUGUU (SEQ ID NO: 1391) | 23 | downstream |
| CEP290-582 | + | ACAGGGUAGGAUUCAUGUU (SEQ ID NO: 1392) | 19 | downstream |
| CEP290-583 | − | ACAGAGUUCAAGCUAAUACAU (SEQ ID NO: 1393) | 21 | downstream |
| CEP290-584 | − | AGAGUUCAAGCUAAUACAU (SEQ ID NO: 1394) | 19 | downstream |
| CEP290-585 | + | AUAAGAUGCAGAACUAGUGUAGAC (SEQ ID NO: 1395) | 24 | downstream |
| CEP290-586 | + | AAGAUGCAGAACUAGUGUAGAC (SEQ ID NO: 1396) | 22 | downstream |
| CEP290-587 | + | AGAUGCAGAACUAGUGUAGAC (SEQ ID NO: 1397) | 21 | downstream |
| CEP290-588 | + | AUGCAGAACUAGUGUAGAC (SEQ ID NO: 1398) | 19 | downstream |
| CEP290-589 | − | AGUAUCUCCUGUUUGGCA (SEQ ID NO: 1399) | 18 | downstream |
| CEP290-590 | − | ACGAAAAUCAGAUUUCAUGUGUG (SEQ ID NO: 1400) | 23 | downstream |
| CEP290-591 | − | AAAAUCAGAUUUCAUGUGUG (SEQ ID NO: 1401) | 20 | downstream |

TABLE 9B-continued

| gRNA Name | DNA Strand | Targeting Domain | Target Site Length | Position relative to mutation |
|---|---|---|---|---|
| CEP290-592 | − | AAAUCAGAUUUCAUGUGUG (SEQ ID NO: 1402) | 19 | downstream |
| CEP290-593 | − | AAUCAGAUUUCAUGUGUG (SEQ ID NO: 1403) | 18 | downstream |
| CEP290-594 | − | ACAAGAAUGAUCAUUCUAAAC (SEQ ID NO: 1404) | 21 | downstream |
| CEP290-595 | − | AAGAAUGAUCAUUCUAAAC (SEQ ID NO: 1405) | 19 | downstream |
| CEP290-596 | − | AGAAUGAUCAUUCUAAAC (SEQ ID NO: 1406) | 18 | downstream |
| CEP290-597 | + | AGGCGGGGAGUCACAUGGGAGUCA (SEQ ID NO: 1407) | 24 | downstream |
| CEP290-598 | + | AGCUUUUGACAGUUUUUAAGGCG (SEQ ID NO: 1408) | 23 | downstream |
| CEP290-599 | + | AAUGAUCAUUCUUGUGGCAGUAAG (SEQ ID NO: 1409) | 24 | downstream |
| CEP290-600 | + | AUGAUCAUUCUUGUGGCAGUAAG (SEQ ID NO: 1410) | 23 | downstream |
| CEP290-601 | + | AUCAUUCUUGUGGCAGUAAG (SEQ ID NO: 833) | 20 | downstream |
| CEP290-602 | − | AUCUAGAGCAAGAGAUGAACUAG (SEQ ID NO: 1412) | 23 | downstream |
| CEP290-603 | − | AGAGCAAGAGAUGAACUAG (SEQ ID NO: 1413) | 19 | downstream |
| CEP290-604 | + | AAUGCCUGAACAAGUUUUGAAAC (SEQ ID NO: 1414) | 23 | downstream |
| CEP290-605 | + | AUGCCUGAACAAGUUUUGAAAC (SEQ ID NO: 1415) | 22 | downstream |
| CEP290-606 | − | AGAUUGAGGUAGAAUCAAGAA (SEQ ID NO: 1416) | 21 | downstream |
| CEP290-607 | − | AUUGAGGUAGAAUCAAGAA (SEQ ID NO: 1417) | 19 | downstream |
| CEP290-608 | + | AUGUAAGACUGGAGAUAGAGAC (SEQ ID NO: 1418) | 22 | downstream |
| CEP290-609 | + | AAGACUGGAGAUAGAGAC (SEQ ID NO: 1419) | 18 | downstream |
| CEP290-610 | + | AGUCACAUGGGAGUCACAGGG (SEQ ID NO: 1420) | 21 | downstream |
| CEP290-611 | − | ACAUAUCUGUCUUCCUUAA (SEQ ID NO: 1421) | 19 | downstream |
| CEP290-612 | − | AAAUCAGAUUUCAUGUGUGAAGAA (SEQ ID NO: 1422) | 24 | downstream |
| CEP290-613 | − | AAUCAGAUUUCAUGUGUGAAGAA (SEQ ID NO: 1423) | 23 | downstream |
| CEP290-614 | − | AUCAGAUUUCAUGUGUGAAGAA (SEQ ID NO: 1424) | 22 | downstream |
| CEP290-615 | − | AGAUUUCAUGUGUGAAGAA (SEQ ID NO: 1425) | 19 | downstream |
| CEP290-616 | + | AAAUAAAACUAAGACACUGCCAAU (SEQ ID NO: 1025) | 24 | downstream |

TABLE 9B-continued

| gRNA Name | DNA Strand | Targeting Domain | Target Site Length | Position relative to mutation |
|---|---|---|---|---|
| CEP290-617 | + | AAUAAAACUAAGACACUGCCAAU (SEQ ID NO: 1026) | 23 | downstream |
| CEP290-618 | + | AUAAAACUAAGACACUGCCAAU (SEQ ID NO: 1027) | 22 | downstream |
| CEP290-619 | + | AAAACUAAGACACUGCCAAU (SEQ ID NO: 610) | 20 | downstream |
| CEP290-620 | + | AAACUAAGACACUGCCAAU (SEQ ID NO: 1028) | 19 | downstream |
| CEP290-621 | + | AACUAAGACACUGCCAAU (SEQ ID NO: 1029) | 18 | downstream |
| CEP290-622 | - | AACUAUUUAAUUUGUUUCUGUGUG (SEQ ID NO: 1431) | 24 | downstream |
| CEP290-623 | - | ACUAUUUAAUUUGUUUCUGUGUG (SEQ ID NO: 1432) | 23 | downstream |
| CEP290-624 | - | AUUUAAUUUGUUUCUGUGUG (SEQ ID NO: 840) | 20 | downstream |
| CEP290-625 | - | CUGUCAAAAGCUACCGGUUACCUG (SEQ ID NO: 1434) | 24 | downstream |
| CEP290-626 | - | CAAAAGCUACCGGUUACCUG (SEQ ID NO: 755) | 20 | downstream |
| CEP290-627 | - | CUUACAUCCUCCUUACUGCCAC (SEQ ID NO: 1436) | 22 | downstream |
| CEP290-628 | - | CAUCCUCCUUACUGCCAC (SEQ ID NO: 1437) | 18 | downstream |
| CEP290-629 | + | CACAGGGUAGGAUUCAUGUU (SEQ ID NO: 846) | 20 | downstream |
| CEP290-630 | + | CAGGGUAGGAUUCAUGUU (SEQ ID NO: 1439) | 18 | downstream |
| CEP290-631 | - | CACAGAGUUCAAGCUAAUACAU (SEQ ID NO: 1440) | 22 | downstream |
| CEP290-632 | - | CAGAGUUCAAGCUAAUACAU (SEQ ID NO: 848) | 20 | downstream |
| CEP290-633 | - | CACGAAAAUCAGAUUUCAUGUGUG (SEQ ID NO: 1442) | 24 | downstream |
| CEP290-634 | - | CGAAAAUCAGAUUUCAUGUGUG (SEQ ID NO: 1443) | 22 | downstream |
| CEP290-635 | - | CCACAAGAAUGAUCAUUCUAAAC (SEQ ID NO: 1444) | 23 | downstream |
| CEP290-636 | - | CACAAGAAUGAUCAUUCUAAAC (SEQ ID NO: 1445) | 22 | downstream |
| CEP290-637 | - | CAAGAAUGAUCAUUCUAAAC (SEQ ID NO: 844) | 20 | downstream |
| CEP290-638 | + | CGGGGAGUCACAUGGGAGUCA (SEQ ID NO: 1447) | 21 | downstream |
| CEP290-639 | + | CUUUUGACAGUUUUUAAGGCG (SEQ ID NO: 1448) | 21 | downstream |
| CEP290-640 | + | CAUUCUUGUGGCAGUAAG (SEQ ID NO: 1449) | 18 | downstream |
| CEP290-641 | - | CAUCUAGAGCAAGAGAUGAACUAG (SEQ ID NO: 1450) | 24 | downstream |

TABLE 9B-continued

| gRNA Name | DNA Strand | Targeting Domain | Target Site Length | Position relative to mutation |
|---|---|---|---|---|
| CEP290-642 | - | CUAGAGCAAGAGAUGAACUAG (SEQ ID NO: 1451) | 21 | downstream |
| CEP290-643 | + | CCUGAACAAGUUUUGAAAC (SEQ ID NO: 1452) | 19 | downstream |
| CEP290-644 | + | CUGAACAAGUUUUGAAAC (SEQ ID NO: 1453) | 18 | downstream |
| CEP290-645 | - | CUCUCUUCCAGUUGUUUUGCUCA (SEQ ID NO: 1454) | 23 | downstream |
| CEP290-646 | - | CUCUUCCAGUUGUUUUGCUCA (SEQ ID NO: 1455) | 21 | downstream |
| CEP290-647 | - | CUUCCAGUUGUUUUGCUCA (SEQ ID NO: 1456) | 19 | downstream |
| CEP290-648 | + | CACAUGGGAGUCACAGGG (SEQ ID NO: 1457) | 18 | downstream |
| CEP290-649 | - | CAUAUCUGUCUUCCUUAA (SEQ ID NO: 1458) | 18 | downstream |
| CEP290-650 | - | CAGAUUUCAUGUGUGAAGAA (SEQ ID NO: 1124) | 20 | downstream |
| CEP290-651 | - | CUAUUUAAUUUGUUUCUGUGUG (SEQ ID NO: 1460) | 22 | downstream |
| CEP290-652 | - | UGUCAAAAGCUACCGGUUACCUG (SEQ ID NO: 1461) | 23 | downstream |
| CEP290-653 | - | UCAAAAGCUACCGGUUACCUG (SEQ ID NO: 1462) | 21 | downstream |
| CEP290-654 | + | UUUUUAAGGCGGGGAGUCACAU (SEQ ID NO: 1463) | 22 | downstream |
| CEP290-655 | + | UUUUAAGGCGGGGAGUCACAU (SEQ ID NO: 1464) | 21 | downstream |
| CEP290-656 | + | UUUAAGGCGGGGAGUCACAU (SEQ ID NO: 619) | 20 | downstream |
| CEP290-657 | + | UUAAGGCGGGGAGUCACAU (SEQ ID NO: 1466) | 19 | downstream |
| CEP290-658 | + | UAAGGCGGGGAGUCACAU (SEQ ID NO: 1467) | 18 | downstream |
| CEP290-659 | - | UCUUACAUCCUCCUUACUGCCAC (SEQ ID NO: 1468) | 23 | downstream |
| CEP290-660 | - | UUACAUCCUCCUUACUGCCAC (SEQ ID NO: 1469) | 21 | downstream |
| CEP290-661 | - | UACAUCCUCCUUACUGCCAC (SEQ ID NO: 875) | 20 | downstream |
| CEP290-662 | + | UCACAGGGUAGGAUUCAUGUU (SEQ ID NO: 1471) | 21 | downstream |
| CEP290-663 | + | UAAGAUGCAGAACUAGUGUAGAC (SEQ ID NO: 1472) | 23 | downstream |
| CEP290-664 | + | UGCAGAACUAGUGUAGAC (SEQ ID NO: 1473) | 18 | downstream |
| CEP290-665 | - | UGUUGAGUAUCUCCUGUUUGGCA (SEQ ID NO: 1474) | 23 | downstream |
| CEP290-666 | - | UUGAGUAUCUCCUGUUUGGCA (SEQ ID NO: 1475) | 21 | downstream |

TABLE 9B-continued

| gRNA Name | DNA Strand | Targeting Domain | Target Site Length | Position relative to mutation |
|---|---|---|---|---|
| CEP290-667 | − | UGAGUAUCUCCUGUUUGGCA (SEQ ID NO: 895) | 20 | downstream |
| CEP290-668 | + | UAGCUUUUGACAGUUUUUAAGGCG (SEQ ID NO: 1477) | 24 | downstream |
| CEP290-669 | + | UUUUGACAGUUUUUAAGGCG (SEQ ID NO: 681) | 20 | downstream |
| CEP290-670 | + | UUUGACAGUUUUUAAGGCG (SEQ ID NO: 1479) | 19 | downstream |
| CEP290-671 | + | UUGACAGUUUUUAAGGCG (SEQ ID NO: 1480) | 18 | downstream |
| CEP290-672 | + | UGAUCAUUCUUGUGGCAGUAAG (SEQ ID NO: 1481) | 22 | downstream |
| CEP290-673 | + | UCAUUCUUGUGGCAGUAAG (SEQ ID NO: 1482) | 19 | downstream |
| CEP290-674 | − | UCUAGAGCAAGAGAUGAACUAG (SEQ ID NO: 1483) | 22 | downstream |
| CEP290-675 | − | UAGAGCAAGAGAUGAACUAG (SEQ ID NO: 878) | 20 | downstream |
| CEP290-676 | + | UAAUGCCUGAACAAGUUUUGAAAC (SEQ ID NO: 1485) | 24 | downstream |
| CEP290-677 | + | UGCCUGAACAAGUUUUGAAAC (SEQ ID NO: 1486) | 21 | downstream |
| CEP290-678 | − | UGUAGAUUGAGGUAGAAUCAAGAA (SEQ ID NO: 1487) | 24 | downstream |
| CEP290-679 | − | UAGAUUGAGGUAGAAUCAAGAA (SEQ ID NO: 1488) | 22 | downstream |
| CEP290-680 | − | UUGAGGUAGAAUCAAGAA (SEQ ID NO: 1489) | 18 | downstream |
| CEP290-681 | + | UGUAAGACUGGAGAUAGAGAC (SEQ ID NO: 1490) | 21 | downstream |
| CEP290-682 | + | UAAGACUGGAGAUAGAGAC (SEQ ID NO: 1491) | 19 | downstream |
| CEP290-683 | − | UCUCUCUUCCAGUUGUUUUGCUCA (SEQ ID NO: 1492) | 24 | downstream |
| CEP290-684 | − | UCUCUUCCAGUUGUUUUGCUCA (SEQ ID NO: 1493) | 22 | downstream |
| CEP290-685 | − | UCUUCCAGUUGUUUUGCUCA (SEQ ID NO: 893) | 20 | downstream |
| CEP290-686 | − | UUCCAGUUGUUUUGCUCA (SEQ ID NO: 1495) | 18 | downstream |
| CEP290-687 | + | UCACAUGGGAGUCACAGGG (SEQ ID NO: 1496) | 19 | downstream |
| CEP290-688 | − | UGUUUACAUAUCUGUCUUCCUUAA (SEQ ID NO: 1497) | 24 | downstream |
| CEP290-689 | − | UUUACAUAUCUGUCUUCCUUAA (SEQ ID NO: 1498) | 22 | downstream |
| CEP290-690 | − | UUACAUAUCUGUCUUCCUUAA (SEQ ID NO: 1499) | 21 | downstream |
| CEP290-691 | − | UACAUAUCUGUCUUCCUUAA (SEQ ID NO: 689) | 20 | downstream |

TABLE 9B-continued

| gRNA Name | DNA Strand | Targeting Domain | Target Site Length | Position relative to mutation |
|---|---|---|---|---|
| CEP290-692 | − | UCAGAUUUCAUGUGUGAAGAA (SEQ ID NO: 1501) | 21 | downstream |
| CEP290-693 | + | UAAAACUAAGACACUGCCAAU (SEQ ID NO: 1035) | 21 | downstream |
| CEP290-694 | − | UAUUUAAUUUGUUUCUGUGUG (SEQ ID NO: 1503) | 21 | downstream |
| CEP290-695 | − | UUUAAUUUGUUUCUGUGUG (SEQ ID NO: 1504) | 19 | downstream |
| CEP290-696 | − | UUAAUUUGUUUCUGUGUG (SEQ ID NO: 1505) | 18 | downstream |

Table 9C provides targeting domains for break-induced deletion of genomic sequence including the mutation at the LCA10 target position in the CEP290 gene selected according to the third tier parameters. The targeting domains are within 1000 bp upstream of an Alu repeat, within 40 bp upstream of mutation, or 1000 bp downstream of the mutation, start with G and PAM is NNGRRT. It is contemplated herein that the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 9C

| gRNA Name | DNA Strand | Targeting Domain | Target Site Length | Position relative to mutation |
|---|---|---|---|---|
| CEP290-697 | − | GUAGAAUAAAUUUAUUUAAUG (SEQ ID NO: 1506) | 21 | upstream |
| CEP290-495 | − | GAAUAAAUUUAUUUAAUG (SEQ ID NO: 1507) | 18 | upstream |
| CEP290-698 | − | GAGAAAAGGAGCAUGAAACAGG (SEQ ID NO: 1508) | 23 | upstream |
| CEP290-699 | − | GAAAAGGAGCAUGAAACAGG (SEQ ID NO: 1509) | 21 | upstream |
| CEP290-700 | − | GUAGAAUAAAAAUAAAAAAC (SEQ ID NO: 1510) | 22 | upstream |
| CEP290-701 | − | GAAUAAAAAUAAAAAAC (SEQ ID NO: 1511) | 19 | upstream |
| CEP290-702 | − | GAAUAAAAAUAAAAAACUAGAG (SEQ ID NO: 1512) | 24 | upstream |
| CEP290-508 | − | GAAAUAGAUGUAGAUUGAGG (SEQ ID NO: 1513) | 20 | downstream |
| CEP290-703 | − | GAUAAUAAGGAAAUACAAAAA (SEQ ID NO: 1514) | 21 | downstream |
| CEP290-704 | − | GUGUUGCCCAGGCUGGAGUGCAG (SEQ ID NO: 1515) | 23 | downstream |
| CEP290-705 | − | GUUGCCCAGGCUGGAGUGCAG (SEQ ID NO: 1516) | 21 | downstream |
| CEP290-706 | − | GCCCAGGCUGGAGUGCAG (SEQ ID NO: 1517) | 18 | downstream |
| CEP290-707 | − | GUUGUUUUUUUUUUGAAA (SEQ ID NO: 1518) | 19 | downstream |

TABLE 9C-continued

| gRNA Name | DNA Strand | Targeting Domain | Length | Target Position Site relative to mutation |
|---|---|---|---|---|
| CEP290-708 | − | GAGUCUCACUGUGUUGCCCAGG C (SEQ ID NO: 1519) | 23 | downstream |
| CEP290-709 | − | GUCUCACUGUGUUGCCCAGGC (SEQ ID NO: 1520) | 21 | downstream |

Table 9D provides targeting domains for break-induced deletion of genomic sequence including the mutation at the LCA10 target position in the CEP290 gene selected according to the fourth tier parameters. The targeting domains are within 1000 bp upstream of an Alu repeat, within 40 bp upstream of mutation, or 1000 bp downstream of the mutation and PAM is NNGRRT. It is contemplated herein that the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 9D

| gRNA Name | DNA Strand | Targeting Domain | Length | Target Position Site relative to mutation |
|---|---|---|---|---|
| CEP290-710 | − | AAUGUAGAAUAAAUUUAUUUAA UG (SEQ ID NO: 1521) | 24 | upstream |
| CEP290-711 | − | AUGUAGAAUAAAUUUAUUUAAU G (SEQ ID NO: 1522) | 23 | upstream |
| CEP290-712 | − | AGAAUAAAUUUAUUUAAUG (SEQ ID NO: 1523) | 19 | upstream |
| CEP290-713 | + | AUUUAUUCUACAAUAAAAAAUGA U (SEQ ID NO: 1524) | 24 | upstream |
| CEP290-714 | + | AUUCUACAAUAAAAAAUGAU (SEQ ID NO: 1525) | 20 | upstream |
| CEP290-715 | − | AGAGAAAAGGAGCAUGAAACAG G (SEQ ID NO: 1526) | 24 | upstream |
| CEP290-716 | − | AGAAAAGGAGCAUGAAACAGG (SEQ ID NO: 1527) | 22 | upstream |
| CEP290-717 | − | AAAAAGGAGCAUGAAACAGG (SEQ ID NO: 1528) | 20 | upstream |
| CEP290-718 | − | AAAAGGAGCAUGAAACAGG (SEQ ID NO: 1529) | 19 | upstream |
| CEP290-719 | − | AAAGGAGCAUGAAACAGG (SEQ ID NO: 1530) | 18 | upstream |
| CEP290-720 | + | ACAAUAAAAAUGAUGAGAAUU UA (SEQ ID NO: 1531) | 24 | upstream |
| CEP290-721 | + | AAUAAAAAUGAUGAGAAUUUA (SEQ ID NO: 1532) | 22 | upstream |
| CEP290-722 | + | AUAAAAAUGAUGAGAAUUUA (SEQ ID NO: 1533) | 21 | upstream |
| CEP290-723 | + | AAAAAUGAUGAGAAUUUA (SEQ ID NO: 1534) | 19 | upstream |
| CEP290-724 | + | AAAAUGAUGAGAAUUUA (SEQ ID NO: 1535) | 18 | upstream |
| CEP290-725 | − | AUGUAGAAUAAAAAUAAAAAA AC (SEQ ID NO: 1536) | 24 | upstream |
| CEP290-726 | − | AGAAUAAAAAUAAAAAAAC (SEQ ID NO: 1537) | 20 | upstream |

TABLE 9D-continued

| gRNA Name | DNA Strand | Targeting Domain | Target Site Length | Position relative to mutation |
|---|---|---|---|---|
| CEP290-727 | − | AAUAAAAAAUAAAAAAAC (SEQ ID NO: 1538) | 18 | upstream |
| CEP290-728 | − | AAUAAAAAAUAAAAAACUAGAG (SEQ ID NO: 1539) | 23 | upstream |
| CEP290-729 | − | AUAAAAAAUAAAAAACUAGAG (SEQ ID NO: 1540) | 22 | upstream |
| CEP290-730 | − | AAAAAAUAAAAAACUAGAG (SEQ ID NO: 1541) | 20 | upstream |
| CEP290-731 | − | AAAAAUAAAAAACUAGAG (SEQ ID NO: 1542) | 19 | upstream |
| CEP290-732 | − | AAAAUAAAAAACUAGAG (SEQ ID NO: 1543) | 18 | upstream |
| CEP290-733 | + | CAAUAAAAAUGAUGAGAAUUUA (SEQ ID NO: 1544) | 23 | upstream |
| CEP290-734 | − | UGUAGAAUAAAUUUAUUUAAUG (SEQ ID NO: 1545) | 22 | upstream |
| CEP290-735 | − | UAGAAUAAAUUUAUUUAAUG (SEQ ID NO: 1546) | 20 | upstream |
| CEP290-736 | + | UUUAUUCUACAAUAAAAAAUGAU (SEQ ID NO: 1547) | 23 | upstream |
| CEP290-737 | + | UUAUUCUACAAUAAAAAAUGAU (SEQ ID NO: 1548) | 22 | upstream |
| CEP290-738 | + | UAUUCUACAAUAAAAAAUGAU (SEQ ID NO: 1549) | 21 | upstream |
| CEP290-739 | + | UUCUACAAUAAAAAAUGAU (SEQ ID NO: 1550) | 19 | upstream |
| CEP290-740 | + | UCUACAAUAAAAAAUGAU (SEQ ID NO: 1551) | 18 | upstream |
| CEP290-741 | + | UAAAAAAUGAUGAGAAUUUA (SEQ ID NO: 1552) | 20 | upstream |
| CEP290-742 | − | UGUAGAAUAAAAAAUAAAAAAC (SEQ ID NO: 1553) | 23 | upstream |
| CEP290-743 | − | UAGAAUAAAAAAUAAAAAAC (SEQ ID NO: 1554) | 21 | upstream |
| CEP290-744 | − | UAAAAAAUAAAAAACUAGAG (SEQ ID NO: 1555) | 21 | upstream |
| CEP290-745 | − | AAAAGAAAUAGAUGUAGAUUGAGG (SEQ ID NO: 1556) | 24 | downstream |
| CEP290-746 | − | AAAGAAAUAGAUGUAGAUUGAG (SEQ ID NO: 1557) | 23 | downstream |
| CEP290-747 | − | AAGAAAUAGAUGUAGAUUGAGG (SEQ ID NO: 1558) | 22 | downstream |
| CEP290-748 | − | AGAAAUAGAUGUAGAUUGAGG (SEQ ID NO: 1559) | 21 | downstream |
| CEP290-749 | − | AAAUAGAUGUAGAUUGAGG (SEQ ID NO: 1560) | 19 | downstream |
| CEP290-750 | − | AAUAGAUGUAGAUUGAGG (SEQ ID NO: 1561) | 18 | downstream |
| CEP290-751 | − | AUAAUAAGGAAAUACAAAACUGG (SEQ ID NO: 1562) | 24 | downstream |

TABLE 9D-continued

| gRNA Name | DNA Strand | Targeting Domain | Target Site Length | Position relative to mutation |
|---|---|---|---|---|
| CEP290-752 | − | AAUAAGGAAAUACAAAAACUGG (SEQ ID NO: 1563) | 22 | downstream |
| CEP290-753 | − | AUAAGGAAAUACAAAAACUGG (SEQ ID NO: 1564) | 21 | downstream |
| CEP290-754 | − | AAGGAAAUACAAAAACUGG (SEQ ID NO: 1565) | 19 | downstream |
| CEP290-755 | − | AGGAAAUACAAAAACUGG (SEQ ID NO: 1566) | 18 | downstream |
| CEP290-756 | − | AUAGAUAAUAAGGAAAUACAAAAA (SEQ ID NO: 1567) | 24 | downstream |
| CEP290-757 | − | AGAUAAUAAGGAAAUACAAAAA (SEQ ID NO: 1568) | 22 | downstream |
| CEP290-758 | − | AUAAUAAGGAAAUACAAAAA (SEQ ID NO: 1569) | 20 | downstream |
| CEP290-759 | − | AAUAAGGAAAUACAAAAA (SEQ ID NO: 1570) | 18 | downstream |
| CEP290-760 | + | AAAAAAAAAAACAACAAAAA (SEQ ID NO: 1571) | 20 | downstream |
| CEP290-761 | + | AAAAAAAAAACAACAAAAA (SEQ ID NO: 1572) | 19 | downstream |
| CEP290-762 | + | AAAAAAAACAACAAAAA (SEQ ID NO: 1573) | 18 | downstream |
| CEP290-763 | − | AGAGUCUCACUGUGUUGCCCAGGC (SEQ ID NO: 1574) | 24 | downstream |
| CEP290-764 | − | AGUCUCACUGUGUUGCCCAGGC (SEQ ID NO: 1575) | 22 | downstream |
| CEP290-765 | + | CAAAAAAAAAAACAACAAAAA (SEQ ID NO: 1576) | 21 | downstream |
| CEP290-766 | − | CUCACUGUGUUGCCCAGGC (SEQ ID NO: 1577) | 19 | downstream |
| CEP290-767 | − | UAAUAAGGAAAUACAAAAACUGG (SEQ ID NO: 1578) | 23 | downstream |
| CEP290-768 | − | UAAGGAAAUACAAAAACUGG (SEQ ID NO: 1579) | 20 | downstream |
| CEP290-769 | − | UAGAUAAUAAGGAAAUACAAAAA (SEQ ID NO: 1580) | 23 | downstream |
| CEP290-770 | − | UAAUAAGGAAAUACAAAAA (SEQ ID NO: 1581) | 19 | downstream |
| CEP290-771 | − | UGUGUUGCCCAGGCUGGAGUGCAG (SEQ ID NO: 1582) | 24 | downstream |
| CEP290-772 | − | UGUUGCCCAGGCUGGAGUGCAG (SEQ ID NO: 1583) | 22 | downstream |
| CEP290-773 | − | UUGCCCAGGCUGGAGUGCAG (SEQ ID NO: 1189) | 20 | downstream |
| CEP290-774 | − | UGCCCAGGCUGGAGUGCAG (SEQ ID NO: 1585) | 19 | downstream |
| CEP290-775 | + | UUUCAAAAAAAAAAACAACAAAAA (SEQ ID NO: 1586) | 24 | downstream |
| CEP290-776 | + | UUCAAAAAAAAAAACAACAAAAA (SEQ ID NO: 1587) | 23 | downstream |

TABLE 9D-continued

| gRNA Name | DNA Strand | Targeting Domain | Target Site Length | Position relative to mutation |
|---|---|---|---|---|
| CEP290-777 | + | UCAAAAAAAAAAACAACAAAAA (SEQ ID NO: 1588) | 22 | downstream |
| CEP290-778 | − | UUUUUGUUGUUUUUUUUUUGAAA (SEQ ID NO: 1589) | 24 | downstream |
| CEP290-779 | − | UUUUGUUGUUUUUUUUUUGAAA (SEQ ID NO: 1590) | 23 | downstream |
| CEP290-780 | − | UUUGUUGUUUUUUUUUUGAAA (SEQ ID NO: 1591) | 22 | downstream |
| CEP290-781 | − | UUGUUGUUUUUUUUUUGAAA (SEQ ID NO: 1592) | 21 | downstream |
| CEP290-782 | − | UGUUGUUUUUUUUUUGAAA (SEQ ID NO: 1593) | 20 | downstream |
| CEP290-783 | − | UUGUUUUUUUUUUGAAA (SEQ ID NO: 1594) | 18 | downstream |
| CEP290-784 | − | UCUCACUGUGUUGCCCAGGC (SEQ ID NO: 1182) | 20 | downstream |
| CEP290-785 | − | UCACUGUGUUGCCCAGGC (SEQ ID NO: 1596) | 18 | downstream |

Table 9E provides targeting domains for break-induced deletion of genomic sequence including the mutation at the LCA10 target position in the CEP290 gene selected according to the fifth tier parameters. The targeting domains are within 1000 bp upstream of an Alu repeat, within 40 bp upstream of mutation, or 1000 bp downstream of the mutation and PAM is NNGRRV. It is contemplated herein that the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 9E

| gRNA Name | DNA Strand | Targeting Domain | Target Site Length | Position relative to mutation |
|---|---|---|---|---|
| CEP290-786 | + | ACUGUUGGCUACAUCCAUUCC (SEQ ID NO: 1597) | 21 | upstream |
| CEP290-787 | + | AAUUUACAGAGUGCAUCCAUGGUC (SEQ ID NO: 1598) | 24 | upstream |
| CEP290-788 | + | AUUUACAGAGUGCAUCCAUGGUC (SEQ ID NO: 1599) | 23 | upstream |
| CEP290-789 | + | ACAGAGUGCAUCCAUGGUC (SEQ ID NO: 1600) | 19 | upstream |
| CEP290-790 | − | AGCAUUAGAAAGUCCUAGGC (SEQ ID NO: 823) | 20 | upstream |
| CEP290-791 | − | AUGGUCCCUGGCUUUUGUUCC (SEQ ID NO: 1602) | 21 | upstream |
| CEP290-792 | − | AUAGAGACACAUUCAGUAA (SEQ ID NO: 1603) | 19 | upstream |
| CEP290-793 | − | AGCUCAAAAGCUUUUGCUGGCUCA (SEQ ID NO: 1604) | 24 | upstream |
| CEP290-794 | − | AAAAGCUUUUGCUGGCUCA (SEQ ID NO: 1605) | 19 | upstream |
| CEP290-795 | − | AAAGCUUUUGCUGGCUCA (SEQ ID NO: 1606) | 18 | upstream |

TABLE 9E-continued

| gRNA Name | DNA Strand | Targeting Domain | Target Site Length | Position relative to mutation |
|---|---|---|---|---|
| CEP290-796 | + | AAUCCAUAAGCCUCUAUUUCUGAU (SEQ ID NO: 1607) | 24 | upstream |
| CEP290-797 | + | AUCCAUAAGCCUCUAUUUCUGAU (SEQ ID NO: 1608) | 23 | upstream |
| CEP290-798 | + | AUAAGCCUCUAUUUCUGAU (SEQ ID NO: 1609) | 19 | upstream |
| CEP290-799 | + | AGCUAAAUCAUGCAAGUGACCUA (SEQ ID NO: 1610) | 23 | upstream |
| CEP290-800 | + | AAAUCAUGCAAGUGACCUA (SEQ ID NO: 1611) | 19 | upstream |
| CEP290-801 | + | AAUCAUGCAAGUGACCUA (SEQ ID NO: 1612) | 18 | upstream |
| CEP290-802 | − | AAACCUCUUUUAACCAGACAUCU (SEQ ID NO: 1613) | 23 | upstream |
| CEP290-803 | − | AACCUCUUUUAACCAGACAUCU (SEQ ID NO: 1614) | 22 | upstream |
| CEP290-804 | − | ACCUCUUUUAACCAGACAUCU (SEQ ID NO: 1615) | 21 | upstream |
| CEP290-805 | + | AGUUUGUUCUGGGUACAGGGGUAA (SEQ ID NO: 1616) | 24 | upstream |
| CEP290-806 | + | AUGACUCAUAAUUUAGUAGGAAUC (SEQ ID NO: 1617) | 24 | upstream |
| CEP290-807 | + | ACUCAUAAUUUAGUAGGAAUC (SEQ ID NO: 1618) | 21 | upstream |
| CEP290-808 | − | AAUGGAUGUAGCCAACAGUAG (SEQ ID NO: 1619) | 21 | upstream |
| CEP290-809 | − | AUGGAUGUAGCCAACAGUAG (SEQ ID NO: 1620) | 20 | upstream |
| CEP290-810 | + | AUCACCUCUCUUUGGCAAAAGCAG (SEQ ID NO: 1621) | 24 | upstream |
| CEP290-811 | + | ACCUCUCUUUGGCAAAAGCAG (SEQ ID NO: 1622) | 21 | upstream |
| CEP290-812 | − | AGGUAGAAUAUUGUAAUCAAAGG (SEQ ID NO: 1623) | 23 | upstream |
| CEP290-813 | − | AGAAUAUUGUAAUCAAAGG (SEQ ID NO: 1624) | 19 | upstream |
| CEP290-814 | + | AAGGAACAAAAGCCAGGGACC (SEQ ID NO: 1625) | 21 | upstream |
| CEP290-815 | + | AGGAACAAAAGCCAGGGACC (SEQ ID NO: 1626) | 20 | upstream |
| CEP290-816 | + | ACAUCCAUUCCAAGGAACAAAAGC (SEQ ID NO: 1627) | 24 | upstream |
| CEP290-817 | + | AUCCAUUCCAAGGAACAAAAGC (SEQ ID NO: 1628) | 22 | upstream |
| CEP290-818 | + | AUUCCAAGGAACAAAAGC (SEQ ID NO: 1629) | 18 | upstream |
| CEP290-819 | + | AGAAUUAGAUCUUAUUCUACUCCU (SEQ ID NO: 1630) | 24 | upstream |
| CEP290-820 | + | AAUUAGAUCUUAUUCUACUCCU (SEQ ID NO: 1631) | 22 | upstream |

TABLE 9E-continued

| gRNA Name | DNA Strand | Targeting Domain | Target Site Length | Position relative to mutation |
|---|---|---|---|---|
| CEP290-821 | + | AUUAGAUCUUAUUCUACUCCU (SEQ ID NO: 1632) | 21 | upstream |
| CEP290-822 | + | AGAUCUUAUUCUACUCCU (SEQ ID NO: 1633) | 18 | upstream |
| CEP290-823 | - | AUUUGUUCAUCUUCCUCAU (SEQ ID NO: 1634) | 19 | upstream |
| CEP290-824 | - | AGAGGUGAUUAUGUUACUUUUUA (SEQ ID NO: 1635) | 23 | upstream |
| CEP290-825 | - | AGGUGAUUAUGUUACUUUUUA (SEQ ID NO: 1636) | 21 | upstream |
| CEP290-826 | - | AACCUCUUUUAACCAGACAUCUAA (SEQ ID NO: 1637) | 24 | upstream |
| CEP290-827 | - | ACCUCUUUUAACCAGACAUCUAA (SEQ ID NO: 1638) | 23 | upstream |
| CEP290-828 | + | AUAAACAUGACUCAUAAUUUAG (SEQ ID NO: 1639) | 22 | upstream |
| CEP290-829 | + | AAACAUGACUCAUAAUUUAG (SEQ ID NO: 805) | 20 | upstream |
| CEP290-830 | + | AACAUGACUCAUAAUUUAG (SEQ ID NO: 1641) | 19 | upstream |
| CEP290-831 | + | ACAUGACUCAUAAUUUAG (SEQ ID NO: 1642) | 18 | upstream |
| CEP290-832 | - | ACAGGUAGAAUAUUGUAAUCAAAG (SEQ ID NO: 1643) | 24 | upstream |
| CEP290-833 | - | AGGUAGAAUAUUGUAAUCAAAG (SEQ ID NO: 1644) | 22 | upstream |
| CEP290-834 | - | AGAAUAUUGUAAUCAAAG (SEQ ID NO: 1645) | 18 | upstream |
| CEP290-835 | + | AUAGUUUGUUCUGGGUACAGGGGU (SEQ ID NO: 1646) | 24 | upstream |
| CEP290-836 | + | AGUUUGUUCUGGGUACAGGGGU (SEQ ID NO: 1647) | 22 | upstream |
| CEP290-837 | - | AGACAUCUAAGAGAAAAGGAGC (SEQ ID NO: 1648) | 23 | upstream |
| CEP290-838 | - | ACAUCUAAGAGAAAAGGAGC (SEQ ID NO: 1649) | 21 | upstream |
| CEP290-839 | - | AUCUAAGAGAAAAGGAGC (SEQ ID NO: 1650) | 19 | upstream |
| CEP290-840 | + | AGAGGAUAGGACAGAGGACA (SEQ ID NO: 735) | 20 | upstream |
| CEP290-841 | + | AGGAUAGGACAGAGGACA (SEQ ID NO: 1652) | 18 | upstream |
| CEP290-842 | + | AGGAAAGAUGAAAAAUACUCUU (SEQ ID NO: 1653) | 22 | upstream |
| CEP290-843 | + | AAAGAUGAAAAAUACUCUU (SEQ ID NO: 1654) | 19 | upstream |
| CEP290-844 | + | AAGAUGAAAAAUACUCUU (SEQ ID NO: 1655) | 18 | upstream |
| CEP290-845 | + | AGGAAAGAUGAAAAAUACUCUUU (SEQ ID NO: 1656) | 23 | upstream |

TABLE 9E-continued

| gRNA Name | DNA Strand | Targeting Domain | Target Site Length | Position relative to mutation |
|---|---|---|---|---|
| CEP290-846 | + | AAAGAUGAAAAAUACUCUUU (SEQ ID NO: 737) | 20 | upstream |
| CEP290-847 | + | AAGAUGAAAAAUACUCUUU (SEQ ID NO: 1658) | 19 | upstream |
| CEP290-848 | + | AGAUGAAAAAUACUCUUU (SEQ ID NO: 1659) | 18 | upstream |
| CEP290-849 | + | AGGAAAGAUGAAAAAUACUCU (SEQ ID NO: 1660) | 21 | upstream |
| CEP290-850 | + | AAAGAUGAAAAAUACUCU (SEQ ID NO: 1661) | 18 | upstream |
| CEP290-851 | + | AUAGGACAGAGGACAUGGAGAA (SEQ ID NO: 1662) | 22 | upstream |
| CEP290-852 | + | AGGACAGAGGACAUGGAGAA (SEQ ID NO: 736) | 20 | upstream |
| CEP290-853 | + | AGGAUAGGACAGAGGACAUGGAGA (SEQ ID NO: 1664) | 24 | upstream |
| CEP290-854 | + | AUAGGACAGAGGACAUGGAGA (SEQ ID NO: 1665) | 21 | upstream |
| CEP290-855 | + | AGGACAGAGGACAUGGAGA (SEQ ID NO: 1666) | 19 | upstream |
| CEP290-856 | + | AAGGAACAAAAGCCAGGGACCAU (SEQ ID NO: 1667) | 23 | upstream |
| CEP290-857 | + | AGGAACAAAAGCCAGGGACCAU (SEQ ID NO: 1668) | 22 | upstream |
| CEP290-858 | + | AACAAAAGCCAGGGACCAU (SEQ ID NO: 1669) | 19 | upstream |
| CEP290-859 | + | ACAAAAGCCAGGGACCAU (SEQ ID NO: 1670) | 18 | upstream |
| CEP290-860 | + | ACAUUUAUUCUACAAUAAAAAUG (SEQ ID NO: 1671) | 24 | upstream |
| CEP290-861 | + | AUUUAUUCUACAAUAAAAAUG (SEQ ID NO: 1672) | 22 | upstream |
| CEP290-862 | + | AUUCUACAAUAAAAAUG (SEQ ID NO: 1673) | 18 | upstream |
| CEP290-863 | + | AUUGUGUGUGUGUGUGUGUUAU (SEQ ID NO: 1674) | 24 | upstream |
| CEP290-864 | + | CUACUGUUGGCUACAUCCAUUCC (SEQ ID NO: 1675) | 23 | upstream |
| CEP290-865 | + | CUGUUGGCUACAUCCAUUCC (SEQ ID NO: 1676) | 20 | upstream |
| CEP290-866 | + | CAGAGUGCAUCCAUGGUC (SEQ ID NO: 1677) | 18 | upstream |
| CEP290-867 | − | CUCCAGCAUUAGAAAGUCCUAGGC (SEQ ID NO: 1678) | 24 | upstream |
| CEP290-868 | − | CCAGCAUUAGAAAGUCCUAGGC (SEQ ID NO: 1679) | 22 | upstream |
| CEP290-869 | − | CAGCAUUAGAAAGUCCUAGGC (SEQ ID NO: 1680) | 21 | upstream |
| CEP290-870 | − | CAUUAGAAAGUCCUAGGC (SEQ ID NO: 1681) | 18 | upstream |

TABLE 9E-continued

| gRNA Name | DNA Strand | Targeting Domain | Target Site Length | Position relative to mutation |
|---|---|---|---|---|
| CEP290-871 | − | CCCAUGGUCCCUGGCUUUUGUUCC (SEQ ID NO: 1682) | 24 | upstream |
| CEP290-872 | − | CCAUGGUCCCUGGCUUUUGUUCC (SEQ ID NO: 1683) | 23 | upstream |
| CEP290-873 | − | CAUGGUCCCUGGCUUUUGUUCC (SEQ ID NO: 1684) | 22 | upstream |
| CEP290-874 | − | CUCAUAGAGACACAUUCAGUAA (SEQ ID NO: 1685) | 22 | upstream |
| CEP290-875 | − | CAUAGAGACACAUUCAGUAA (SEQ ID NO: 750) | 20 | upstream |
| CEP290-876 | − | CUCAAAAGCUUUUGCUGGCUCA (SEQ ID NO: 1687) | 22 | upstream |
| CEP290-877 | − | CAAAAGCUUUUGCUGGCUCA (SEQ ID NO: 762) | 20 | upstream |
| CEP290-878 | + | CCAUAAGCCUCUAUUUCUGAU (SEQ ID NO: 1689) | 21 | upstream |
| CEP290-879 | + | CAUAAGCCUCUAUUUCUGAU (SEQ ID NO: 851) | 20 | upstream |
| CEP290-880 | + | CAGCUAAAUCAUGCAAGUGACCUA (SEQ ID NO: 1691) | 24 | upstream |
| CEP290-881 | + | CUAAAUCAUGCAAGUGACCUA (SEQ ID NO: 1692) | 21 | upstream |
| CEP290-882 | − | CAAACCUCUUUUAACCAGACAUCU (SEQ ID NO: 1693) | 24 | upstream |
| CEP290-883 | − | CCUCUUUUAACCAGACAUCU (SEQ ID NO: 1694) | 20 | upstream |
| CEP290-884 | − | CUCUUUUAACCAGACAUCU (SEQ ID NO: 1695) | 19 | upstream |
| CEP290-885 | + | CUCAUAAUUUAGUAGGAAUC (SEQ ID NO: 864) | 20 | upstream |
| CEP290-886 | + | CAUAAUUUAGUAGGAAUC (SEQ ID NO: 1697) | 18 | upstream |
| CEP290-887 | + | CACCUCUCUUUGGCAAAGCAG (SEQ ID NO: 1698) | 22 | upstream |
| CEP290-888 | + | CCUCUCUUUGGCAAAGCAG (SEQ ID NO: 859) | 20 | upstream |
| CEP290-889 | + | CUCUCUUUGGCAAAGCAG (SEQ ID NO: 1700) | 19 | upstream |
| CEP290-890 | − | CAGGUAGAAUAUUGUAAUCAAAGG (SEQ ID NO: 1701) | 24 | upstream |
| CEP290-891 | + | CCAAGGAACAAAAGCCAGGGACC (SEQ ID NO: 1702) | 23 | upstream |
| CEP290-892 | + | CAAGGAACAAAAGCCAGGGACC (SEQ ID NO: 1703) | 22 | upstream |
| CEP290-893 | + | CAUCCAUUCCAAGGAACAAAAGC (SEQ ID NO: 1704) | 23 | upstream |
| CEP290-894 | + | CCAUUCCAAGGAACAAAAGC (SEQ ID NO: 1705) | 20 | upstream |
| CEP290-895 | + | CAUUCCAAGGAACAAAAGC (SEQ ID NO: 1706) | 19 | upstream |

TABLE 9E-continued

| gRNA Name | DNA Strand | Targeting Domain | Target Site Length | Position relative to mutation |
|---|---|---|---|---|
| CEP290-896 | + | CUCUUGCCUAGGACUUUCUAAUGC (SEQ ID NO: 1707) | 24 | upstream |
| CEP290-897 | + | CUUGCCUAGGACUUUCUAAUGC (SEQ ID NO: 1708) | 22 | upstream |
| CEP290-898 | + | CCUAGGACUUUCUAAUGC (SEQ ID NO: 1709) | 18 | upstream |
| CEP290-899 | − | CCUGAUUUGUUCAUCUUCCUCAU (SEQ ID NO: 1710) | 23 | upstream |
| CEP290-900 | − | CUGAUUUGUUCAUCUUCCUCAU (SEQ ID NO: 1711) | 22 | upstream |
| CEP290-901 | − | CCUCUUUUAACCAGACAUCUAA (SEQ ID NO: 1712) | 22 | upstream |
| CEP290-902 | − | CUCUUUUAACCAGACAUCUAA (SEQ ID NO: 1713) | 21 | upstream |
| CEP290-903 | − | CUUUUAACCAGACAUCUAA (SEQ ID NO: 1714) | 19 | upstream |
| CEP290-904 | − | CCUCUGUCCUAUCCUCUCCAGCAU (SEQ ID NO: 1715) | 24 | upstream |
| CEP290-905 | − | CUCUGUCCUAUCCUCUCCAGCAU (SEQ ID NO: 1716) | 23 | upstream |
| CEP290-906 | − | CUGUCCUAUCCUCUCCAGCAU (SEQ ID NO: 1717) | 21 | upstream |
| CEP290-907 | − | CAGGUAGAAUAUUGUAAUCAAAG (SEQ ID NO: 1718) | 23 | upstream |
| CEP290-908 | + | CUGGGUACAGGGGUAAGAGA (SEQ ID NO: 1719) | 20 | upstream |
| CEP290-909 | − | CUUUCUGCUGCUUUUGCCA (SEQ ID NO: 1720) | 19 | upstream |
| CEP290-910 | − | CAGACAUCUAAGAGAAAAAGGAGC (SEQ ID NO: 1721) | 24 | upstream |
| CEP290-911 | − | CAUCUAAGAGAAAAAGGAGC (SEQ ID NO: 1722) | 20 | upstream |
| CEP290-912 | + | CUGGAGAGGAUAGGACAGAGGACA (SEQ ID NO: 1723) | 24 | upstream |
| CEP290-913 | + | CAAGGAACAAAAGCCAGGGACCAU (SEQ ID NO: 1724) | 24 | upstream |
| CEP290-914 | + | CAUUUAUUCUACAAUAAAAAAUG (SEQ ID NO: 1725) | 23 | upstream |
| CEP290-915 | + | GCUACUGUUGGCUACAUCCAUUCC (SEQ ID NO: 1726) | 24 | upstream |
| CEP290-916 | + | GUUGGCUACAUCCAUUCC (SEQ ID NO: 1727) | 18 | upstream |
| CEP290-917 | − | GCAUUAGAAAGUCCUAGGC (SEQ ID NO: 1728) | 19 | upstream |
| CEP290-918 | − | GGUCCUGGCUUUUGUUCC (SEQ ID NO: 1729) | 19 | upstream |
| CEP290-919 | − | GUCCUGGCUUUUGUUCC (SEQ ID NO: 1730) | 18 | upstream |
| CEP290-920 | − | GGCUCAUAGAGACACAUUCAGUAA (SEQ ID NO: 1731) | 24 | upstream |

TABLE 9E-continued

| gRNA Name | DNA Strand | Targeting Domain | Target Site Length | Position relative to mutation |
|---|---|---|---|---|
| CEP290-921 | - | GCUCAUAGAGACACAUUCAGUAA (SEQ ID NO: 1732) | 23 | upstream |
| CEP290-922 | - | GCUCAAAAGCUUUUGCUGGCUCA (SEQ ID NO: 1733) | 23 | upstream |
| CEP290-923 | + | GCUAAAUCAUGCAAGUGACCUA (SEQ ID NO: 1734) | 22 | upstream |
| CEP290-924 | + | GUUUGUUCUGGGUACAGGGGUAA (SEQ ID NO: 1735) | 23 | upstream |
| CEP290-925 | + | GUUCUGGGUACAGGGGUAA (SEQ ID NO: 1736) | 19 | upstream |
| CEP290-926 | + | GACUCAUAAUUUAGUAGGAAUC (SEQ ID NO: 1737) | 22 | upstream |
| CEP290-927 | - | GGAAUGGAUGUAGCCAACAGUAG (SEQ ID NO: 1738) | 23 | upstream |
| CEP290-928 | - | GAAUGGAUGUAGCCAACAGUAG (SEQ ID NO: 1739) | 22 | upstream |
| CEP290-929 | - | GGAUGUAGCCAACAGUAG (SEQ ID NO: 1740) | 18 | upstream |
| CEP290-930 | - | GGUAGAAUAUUGUAAUCAAAGG (SEQ ID NO: 1741) | 22 | upstream |
| CEP290-931 | - | GUAGAAUAUUGUAAUCAAAGG (SEQ ID NO: 1742) | 21 | upstream |
| CEP290-932 | - | GAAUAUUGUAAUCAAAGG (SEQ ID NO: 1743) | 18 | upstream |
| CEP290-933 | + | GGAACAAAAGCCAGGGACC (SEQ ID NO: 1744) | 19 | upstream |
| CEP290-934 | + | GAACAAAAGCCAGGGACC (SEQ ID NO: 1745) | 18 | upstream |
| CEP290-935 | + | GAAUUAGAUCUUAUUCUACUCCU (SEQ ID NO: 1746) | 23 | upstream |
| CEP290-936 | + | GCCUAGGACUUUCUAAUGC (SEQ ID NO: 1747) | 19 | upstream |
| CEP290-937 | - | GAUUUGUUCAUCUUCCUCAU (SEQ ID NO: 774) | 20 | upstream |
| CEP290-938 | - | GAGAGGUGAUUAUGUUACUUUUUA (SEQ ID NO: 1749) | 24 | upstream |
| CEP290-939 | - | GAGGUGAUUAUGUUACUUUUUA (SEQ ID NO: 1750) | 22 | upstream |
| CEP290-940 | - | GGUGAUUAUGUUACUUUUUA (SEQ ID NO: 780) | 20 | upstream |
| CEP290-941 | - | GUGAUUAUGUUACUUUUUA (SEQ ID NO: 1752) | 19 | upstream |
| CEP290-942 | - | GUCCUAUCCUCUCCAGCAU (SEQ ID NO: 1753) | 19 | upstream |
| CEP290-943 | + | GAUAAACAUGACUCAUAAUUUAG (SEQ ID NO: 1754) | 23 | upstream |
| CEP290-944 | - | GGUAGAAUAUUGUAAUCAAAG (SEQ ID NO: 1755) | 21 | upstream |
| CEP290-945 | - | GUAGAAUAUUGUAAUCAAAG (SEQ ID NO: 1756) | 20 | upstream |

TABLE 9E-continued

| gRNA Name | DNA Strand | Targeting Domain | Target Site Length | Position relative to mutation |
|---|---|---|---|---|
| CEP290-946 | + | GUUCUGGGUACAGGGGUAAGAGA (SEQ ID NO: 1757) | 23 | upstream |
| CEP290-947 | + | GGGUACAGGGGUAAGAGA (SEQ ID NO: 1758) | 18 | upstream |
| CEP290-948 | + | GUUUGUUCUGGGUACAGGGGU (SEQ ID NO: 1759) | 21 | upstream |
| CEP290-949 | − | GUUUGCUUUCUGCUGCUUUUGCCA (SEQ ID NO: 1760) | 24 | upstream |
| CEP290-950 | − | GCUUUCUGCUGCUUUUGCCA (SEQ ID NO: 776) | 20 | upstream |
| CEP290-951 | − | GACAUCUAAGAGAAAAAGGAGC (SEQ ID NO: 1762) | 22 | upstream |
| CEP290-952 | + | GGAGAGGAUAGGACAGAGGACA (SEQ ID NO: 1763) | 22 | upstream |
| CEP290-953 | + | GAGAGGAUAGGACAGAGGACA (SEQ ID NO: 1764) | 21 | upstream |
| CEP290-954 | + | GAGGAUAGGACAGAGGACA (SEQ ID NO: 1765) | 19 | upstream |
| CEP290-955 | + | GGAAAGAUGAAAAAUACUCUU (SEQ ID NO: 1766) | 21 | upstream |
| CEP290-956 | + | GAAAGAUGAAAAAUACUCUU (SEQ ID NO: 462) | 20 | upstream |
| CEP290-957 | + | GGAAAGAUGAAAAAUACUCUUU (SEQ ID NO: 1767) | 22 | upstream |
| CEP290-958 | + | GAAAGAUGAAAAAUACUCUUU (SEQ ID NO: 1768) | 21 | upstream |
| CEP290-959 | + | GGAAAGAUGAAAAAUACUCU (SEQ ID NO: 778) | 20 | upstream |
| CEP290-960 | + | GAAAGAUGAAAAAUACUCU (SEQ ID NO: 1770) | 19 | upstream |
| CEP290-961 | + | GGAUAGGACAGAGGACAUGGAGAA (SEQ ID NO: 1771) | 24 | upstream |
| CEP290-962 | + | GAUAGGACAGAGGACAUGGAGAA (SEQ ID NO: 1772) | 23 | upstream |
| CEP290-963 | + | GGACAGAGGACAUGGAGAA (SEQ ID NO: 1773) | 19 | upstream |
| CEP290-964 | + | GACAGAGGACAUGGAGAA (SEQ ID NO: 1774) | 18 | upstream |
| CEP290-965 | + | GGAUAGGACAGAGGACAUGGAGA (SEQ ID NO: 1775) | 23 | upstream |
| CEP290-966 | + | GAUAGGACAGAGGACAUGGAGA (SEQ ID NO: 1776) | 22 | upstream |
| CEP290-967 | + | GGACAGAGGACAUGGAGA (SEQ ID NO: 1777) | 18 | upstream |
| CEP290-968 | + | GGAACAAAAGCCAGGGACCAU (SEQ ID NO: 1778) | 21 | upstream |
| CEP290-969 | + | GAACAAAAGCCAGGGACCAU (SEQ ID NO: 465) | 20 | upstream |
| CEP290-970 | + | GUGUGUGUGUGUGUGUUAU (SEQ ID NO: 1779) | 21 | upstream |

TABLE 9E-continued

| gRNA Name | DNA Strand | Targeting Domain | Target Site Length | Position relative to mutation |
|---|---|---|---|---|
| CEP290-971 | + | GUGUGUGUGUGUGUGUUAU (SEQ ID NO: 1780) | 19 | upstream |
| CEP290-972 | + | GUGUGUGUGUGUGUGUUAUG (SEQ ID NO: 1781) | 22 | upstream |
| CEP290-973 | + | GUGUGUGUGUGUGUUAUG (SEQ ID NO: 1154) | 20 | upstream |
| CEP290-974 | + | GUGUGUGUGUGUUAUG (SEQ ID NO: 1783) | 18 | upstream |
| CEP290-975 | + | UACUGUUGGCUACAUCCAUUCC (SEQ ID NO: 1784) | 22 | upstream |
| CEP290-976 | + | UGUUGGCUACAUCCAUUCC (SEQ ID NO: 1785) | 19 | upstream |
| CEP290-977 | + | UUUACAGAGUGCAUCCAUGGUC (SEQ ID NO: 1786) | 22 | upstream |
| CEP290-978 | + | UUACAGAGUGCAUCCAUGGUC (SEQ ID NO: 1787) | 21 | upstream |
| CEP290-979 | + | UACAGAGUGCAUCCAUGGUC (SEQ ID NO: 1788) | 20 | upstream |
| CEP290-980 | − | UCCAGCAUUAGAAAGUCCUAGGC (SEQ ID NO: 1789) | 23 | upstream |
| CEP290-981 | − | UGGUCCCUGGCUUUUGUUCC (SEQ ID NO: 1790) | 20 | upstream |
| CEP290-982 | − | UCAUAGAGACACAUUCAGUAA (SEQ ID NO: 1791) | 21 | upstream |
| CEP290-983 | − | UAGAGACACAUUCAGUAA (SEQ ID NO: 1792) | 18 | upstream |
| CEP290-984 | − | UCAAAAGCUUUUGCUGGCUCA (SEQ ID NO: 1793) | 21 | upstream |
| CEP290-985 | + | UCCAUAAGCCUCUAUUUCUGAU (SEQ ID NO: 1794) | 22 | upstream |
| CEP290-986 | + | UAAGCCUCUAUUUCUGAU (SEQ ID NO: 1795) | 18 | upstream |
| CEP290-987 | + | UAAAUCAUGCAAGUGACCUA (SEQ ID NO: 508) | 20 | upstream |
| CEP290-988 | − | UCUUUUAACCAGACAUCU (SEQ ID NO: 1796) | 18 | upstream |
| CEP290-989 | + | UUUGUUCUGGGUACAGGGGUAA (SEQ ID NO: 1797) | 22 | upstream |
| CEP290-990 | + | UUGUUCUGGGUACAGGGGUAA (SEQ ID NO: 1798) | 21 | upstream |
| CEP290-991 | + | UGUUCUGGGUACAGGGGUAA (SEQ ID NO: 1799) | 20 | upstream |
| CEP290-992 | + | UUCUGGGUACAGGGGUAA (SEQ ID NO: 1800) | 18 | upstream |
| CEP290-993 | + | UGACUCAUAAUUUAGUAGGAAUC (SEQ ID NO: 1801) | 23 | upstream |
| CEP290-994 | + | UCAUAAUUUAGUAGGAAUC (SEQ ID NO: 1802) | 19 | upstream |
| CEP290-995 | − | UGGAAUGGAUGUAGCCAACAGUAG (SEQ ID NO: 1803) | 24 | upstream |

TABLE 9E-continued

| gRNA Name | DNA Strand | Targeting Domain | Target Site Length | Position relative to mutation |
|---|---|---|---|---|
| CEP290-996 | − | UGGAUGUAGCCAACAGUAG (SEQ ID NO: 1804) | 19 | upstream |
| CEP290-997 | + | UCACCUCUCUUUGGCAAAAGCAG (SEQ ID NO: 1805) | 23 | upstream |
| CEP290-998 | + | UCUCUUUGGCAAAAGCAG (SEQ ID NO: 1806) | 18 | upstream |
| CEP290-999 | − | UAGAAUAUUGUAAUCAAAGG (SEQ ID NO: 1807) | 20 | upstream |
| CEP290-1000 | + | UCCAAGGAACAAAAGCCAGGGACC (SEQ ID NO: 1808) | 24 | upstream |
| CEP290-1001 | + | UCCAUUCCAAGGAACAAAAGC (SEQ ID NO: 1809) | 21 | upstream |
| CEP290-1002 | + | UUAGAUCUUAUUCUACUCCU (SEQ ID NO: 902) | 20 | upstream |
| CEP290-1003 | + | UAGAUCUUAUUCUACUCCU (SEQ ID NO: 1811) | 19 | upstream |
| CEP290-1004 | + | UCUUGCCUAGGACUUUCUAAUGC (SEQ ID NO: 1812) | 23 | upstream |
| CEP290-1005 | + | UUGCCUAGGACUUUCUAAUGC (SEQ ID NO: 1813) | 21 | upstream |
| CEP290-1006 | + | UGCCUAGGACUUUCUAAUGC (SEQ ID NO: 632) | 20 | upstream |
| CEP290-1007 | − | UCCUGAUUGUUCAUCUUCCUCAU (SEQ ID NO: 1814) | 24 | upstream |
| CEP290-1008 | − | UGAUUGUUCAUCUUCCUCAU (SEQ ID NO: 1815) | 21 | upstream |
| CEP290-1009 | − | UUUGUUCAUCUUCCUCAU (SEQ ID NO: 1816) | 18 | upstream |
| CEP290-1010 | − | UGAUUAUGUUACUUUUUA (SEQ ID NO: 1817) | 18 | upstream |
| CEP290-1011 | − | UCUUUUAACCAGACAUCUAA (SEQ ID NO: 1818) | 20 | upstream |
| CEP290-1012 | − | UUUUAACCAGACAUCUAA (SEQ ID NO: 1819) | 18 | upstream |
| CEP290-1013 | − | UCUGUCCUAUCCUCUCCAGCAU (SEQ ID NO: 1820) | 22 | upstream |
| CEP290-1014 | − | UGUCCUAUCCUCUCCAGCAU (SEQ ID NO: 899) | 20 | upstream |
| CEP290-1015 | − | UCCUAUCCUCUCCAGCAU (SEQ ID NO: 1822) | 18 | upstream |
| CEP290-1016 | + | UGAUAAACAUGACUCAUAAUUUAG (SEQ ID NO: 1823) | 24 | upstream |
| CEP290-1017 | + | UAAACAUGACUCAUAAUUUAG (SEQ ID NO: 1824) | 21 | upstream |
| CEP290-1018 | − | UAGAAUAUUGUAAUCAAAG (SEQ ID NO: 1825) | 19 | upstream |
| CEP290-1019 | + | UGUUCUGGGUACAGGGGUAAGAGA (SEQ ID NO: 1826) | 24 | upstream |
| CEP290-1020 | + | UUCUGGGUACAGGGGUAAGAGA (SEQ ID NO: 1827) | 22 | upstream |

TABLE 9E-continued

| gRNA Name | DNA Strand | Targeting Domain | Target Site Length | Position relative to mutation |
|---|---|---|---|---|
| CEP290-1021 | + | UCUGGGUACAGGGGUAAGAGA (SEQ ID NO: 1828) | 21 | upstream |
| CEP290-1022 | + | UGGGUACAGGGGUAAGAGA (SEQ ID NO: 1829) | 19 | upstream |
| CEP290-1023 | + | UAGUUUGUUCUGGGUACAGGGGU (SEQ ID NO: 1830) | 23 | upstream |
| CEP290-1024 | + | UUUGUUCUGGGUACAGGGGU (SEQ ID NO: 1831) | 20 | upstream |
| CEP290-1025 | + | UUGUUCUGGGUACAGGGGU (SEQ ID NO: 1832) | 19 | upstream |
| CEP290-1026 | + | UGUUCUGGGUACAGGGGU (SEQ ID NO: 1833) | 18 | upstream |
| CEP290-1027 | − | UUUGCUUUCUGCUGCUUUUGCCA (SEQ ID NO: 1834) | 23 | upstream |
| CEP290-1028 | − | UUGCUUUCUGCUGCUUUUGCCA (SEQ ID NO: 1835) | 22 | upstream |
| CEP290-1029 | − | UGCUUUCUGCUGCUUUUGCCA (SEQ ID NO: 1836) | 21 | upstream |
| CEP290-1030 | − | UUUCUGCUGCUUUUGCCA (SEQ ID NO: 1837) | 18 | upstream |
| CEP290-1031 | − | UCUAAGAGAAAAAGGAGC (SEQ ID NO: 1838) | 18 | upstream |
| CEP290-1032 | + | UGGAGAGGAUAGGACAGAGGACA (SEQ ID NO: 1839) | 23 | upstream |
| CEP290-1033 | + | UUAGGAAAGAUGAAAAAUACUCUU (SEQ ID NO: 1840) | 24 | upstream |
| CEP290-1034 | + | UAGGAAAGAUGAAAAAUACUCUU (SEQ ID NO: 1841) | 23 | upstream |
| CEP290-1035 | + | UAGGAAAGAUGAAAAAUACUCUUU (SEQ ID NO: 1842) | 24 | upstream |
| CEP290-1036 | + | UUUAGGAAAGAUGAAAAAUACUCU (SEQ ID NO: 1843) | 24 | upstream |
| CEP290-1037 | + | UUAGGAAAGAUGAAAAAUACUCU (SEQ ID NO: 1844) | 23 | upstream |
| CEP290-1038 | + | UAGGAAAGAUGAAAAAUACUCU (SEQ ID NO: 1845) | 22 | upstream |
| CEP290-1039 | + | UAGGACAGAGGACAUGGAGAA (SEQ ID NO: 1846) | 21 | upstream |
| CEP290-1040 | + | UAGGACAGAGGACAUGGAGA (SEQ ID NO: 881) | 20 | upstream |
| CEP290-1041 | + | UUUAUUCUACAAUAAAAAUG (SEQ ID NO: 1848) | 21 | upstream |
| CEP290-1042 | + | UUAUUCUACAAUAAAAAUG (SEQ ID NO: 1849) | 20 | upstream |
| CEP290-1043 | + | UAUUCUACAAUAAAAAUG (SEQ ID NO: 1850) | 19 | upstream |
| CEP290-1044 | + | UUGUGUGUGUGUGUGUGUUAU (SEQ ID NO: 1851) | 23 | upstream |
| CEP290-1045 | + | UGUGUGUGUGUGUGUGUUAU (SEQ ID NO: 1852) | 22 | upstream |

TABLE 9E-continued

| gRNA Name | DNA Strand | Targeting Domain | Target Site Length | Position relative to mutation |
|---|---|---|---|---|
| CEP290-1046 | + | UGUGUGUGUGUGUGUGUUAU (SEQ ID NO: 1853) | 20 | upstream |
| CEP290-1047 | + | UGUGUGUGUGUGUGUUAU (SEQ ID NO: 1854) | 18 | upstream |
| CEP290-1048 | + | UUGUGUGUGUGUGUGUGUUAUG (SEQ ID NO: 1855) | 24 | upstream |
| CEP290-1049 | + | UGUGUGUGUGUGUGUGUUAUG (SEQ ID NO: 1856) | 23 | upstream |
| CEP290-1050 | + | UGUGUGUGUGUGUGUUAUG (SEQ ID NO: 1857) | 21 | upstream |
| CEP290-1051 | + | UGUGUGUGUGUGUUAUG (SEQ ID NO: 1858) | 19 | upstream |
| CEP290-1052 | + | ACUGUUGGCUACAUCCAUUCCA (SEQ ID NO: 1859) | 22 | upstream |
| CEP290-1053 | + | AUUAUCCACAAGAUGUCUCUUGCC (SEQ ID NO: 1860) | 24 | upstream |
| CEP290-1054 | + | AUCCACAAGAUGUCUCUUGCC (SEQ ID NO: 1861) | 21 | upstream |
| CEP290-1055 | + | AUGAGCCAGCAAAAGCUU (SEQ ID NO: 1862) | 18 | upstream |
| CEP290-1056 | + | ACAGAGUGCAUCCAUGGUCCAGG (SEQ ID NO: 1863) | 23 | upstream |
| CEP290-1057 | + | AGAGUGCAUCCAUGGUCCAGG (SEQ ID NO: 1864) | 21 | upstream |
| CEP290-1058 | + | AGUGCAUCCAUGGUCCAGG (SEQ ID NO: 1865) | 19 | upstream |
| CEP290-1059 | − | AGCUGAAAUAUUAAGGGCUCUUC (SEQ ID NO: 1866) | 23 | upstream |
| CEP290-1060 | − | AAAUAUUAAGGGCUCUUC (SEQ ID NO: 1867) | 18 | upstream |
| CEP290-1061 | − | AACUCUAUACCUUUUACUGAGGA (SEQ ID NO: 1868) | 23 | upstream |
| CEP290-1062 | − | ACUCUAUACCUUUUACUGAGGA (SEQ ID NO: 1869) | 22 | upstream |
| CEP290-1063 | − | ACUUGAACUCUAUACCUUUUACU (SEQ ID NO: 1870) | 23 | upstream |
| CEP290-1064 | − | AACUCUAUACCUUUUACU (SEQ ID NO: 1871) | 18 | upstream |
| CEP290-1065 | + | AGUAGGAAUCCUGAAAGCUACU (SEQ ID NO: 1872) | 22 | upstream |
| CEP290-1066 | + | AGGAAUCCUGAAAGCUACU (SEQ ID NO: 1873) | 19 | upstream |
| CEP290-1067 | − | AGCCAACAGUAGCUGAAAUAUU (SEQ ID NO: 1874) | 22 | upstream |
| CEP290-1068 | − | AACAGUAGCUGAAAUAUU (SEQ ID NO: 1875) | 18 | upstream |
| CEP290-1069 | + | AUCCAUUCCAAGGAACAAAAGCC (SEQ ID NO: 1876) | 23 | upstream |
| CEP290-1070 | + | AUUCCAAGGAACAAAAGCC (SEQ ID NO: 1877) | 19 | upstream |

TABLE 9E-continued

| gRNA Name | DNA Strand | Targeting Domain | Target Site Length | Position relative to mutation |
|---|---|---|---|---|
| CEP290-1071 | − | AUCCCUUUCUCUUACCCCUGUACC (SEQ ID NO: 1878) | 24 | upstream |
| CEP290-1072 | + | AGGACUUUCUAAUGCUGGAGAGGA (SEQ ID NO: 1879) | 24 | upstream |
| CEP290-1073 | + | ACUUUCUAAUGCUGGAGAGGA (SEQ ID NO: 1880) | 21 | upstream |
| CEP290-1074 | + | AAUGCUGGAGAGGAUAGGACA (SEQ ID NO: 1881) | 21 | upstream |
| CEP290-1075 | + | AUGCUGGAGAGGAUAGGACA (SEQ ID NO: 838) | 20 | upstream |
| CEP290-1076 | − | AUCAUAAGUUACAAUCUGUGAAU (SEQ ID NO: 1883) | 23 | upstream |
| CEP290-1077 | − | AUAAGUUACAAUCUGUGAAU (SEQ ID NO: 1884) | 20 | upstream |
| CEP290-1078 | − | AAGUUACAAUCUGUGAAU (SEQ ID NO: 1885) | 18 | upstream |
| CEP290-1079 | − | AACCAGACAUCUAAGAGAAAA (SEQ ID NO: 1886) | 21 | upstream |
| CEP290-1080 | − | ACCAGACAUCUAAGAGAAAA (SEQ ID NO: 1087) | 20 | upstream |
| CEP290-1081 | + | AAGCCUCUAUUUCUGAUGAGGAAG (SEQ ID NO: 1888) | 24 | upstream |
| CEP290-1082 | + | AGCCUCUAUUUCUGAUGAGGAAG (SEQ ID NO: 1889) | 23 | upstream |
| CEP290-1083 | + | AUGAGGAAGAUGAACAAAUC (SEQ ID NO: 733) | 20 | upstream |
| CEP290-1084 | + | AUUUACUGAAUGUGUCUCU (SEQ ID NO: 1891) | 19 | upstream |
| CEP290-1085 | + | ACAGGGGUAAGAGAAAGGG (SEQ ID NO: 1892) | 19 | upstream |
| CEP290-1086 | + | CUACUGUUGGCUACAUCCAUUCCA (SEQ ID NO: 1893) | 24 | upstream |
| CEP290-1087 | + | CUGUUGGCUACAUCCAUUCCA (SEQ ID NO: 1894) | 21 | upstream |
| CEP290-1088 | + | CCACAAGAUGUCUCUUGCC (SEQ ID NO: 1895) | 19 | upstream |
| CEP290-1089 | + | CACAAGAUGUCUCUUGCC (SEQ ID NO: 1896) | 18 | upstream |
| CEP290-1090 | − | CCUUUGUAGUUAUCUUACAGCCAC (SEQ ID NO: 1897) | 24 | upstream |
| CEP290-1091 | − | CUUUGUAGUUAUCUUACAGCCAC (SEQ ID NO: 1898) | 23 | upstream |
| CEP290-1092 | + | CUCUAUGAGCCAGCAAAAGCUU (SEQ ID NO: 1899) | 22 | upstream |
| CEP290-1093 | + | CUAUGAGCCAGCAAAAGCUU (SEQ ID NO: 748) | 20 | upstream |
| CEP290-1094 | + | CAGAGUGCAUCCAUGGUCCAGG (SEQ ID NO: 1901) | 22 | upstream |
| CEP290-1095 | − | CUGAAAUAUUAAGGGCUCUUC (SEQ ID NO: 1902) | 21 | upstream |

TABLE 9E-continued

| gRNA Name | DNA Strand | Targeting Domain | Target Site Length | Position relative to mutation |
|---|---|---|---|---|
| CEP290-1096 | − | CUCUAUACCUUUUACUGAGGA (SEQ ID NO: 1903) | 21 | upstream |
| CEP290-1097 | − | CUAUACCUUUUACUGAGGA (SEQ ID NO: 1904) | 19 | upstream |
| CEP290-1098 | − | CACUUGAACUCUAUACCUUUUACU (SEQ ID NO: 1905) | 24 | upstream |
| CEP290-1099 | − | CUUGAACUCUAUACCUUUUACU (SEQ ID NO: 1906) | 22 | upstream |
| CEP290-1100 | − | CCAACAGUAGCUGAAAUAUU (SEQ ID NO: 1907) | 20 | upstream |
| CEP290-1101 | − | CAACAGUAGCUGAAAUAUU (SEQ ID NO: 1908) | 19 | upstream |
| CEP290-1102 | + | CAUCCAUUCCAAGGAACAAAAGCC (SEQ ID NO: 1909) | 24 | upstream |
| CEP290-1103 | + | CCAUUCCAAGGAACAAAAGCC (SEQ ID NO: 1910) | 21 | upstream |
| CEP290-1104 | + | CAUUCCAAGGAACAAAAGCC (SEQ ID NO: 1131) | 20 | upstream |
| CEP290-1105 | − | CCCUUUCUCUUACCCCUGUACC (SEQ ID NO: 1912) | 22 | upstream |
| CEP290-1106 | − | CCUUUCUCUUACCCCUGUACC (SEQ ID NO: 1913) | 21 | upstream |
| CEP290-1107 | − | CUUUCUCUUACCCCUGUACC (SEQ ID NO: 1914) | 20 | upstream |
| CEP290-1108 | + | CUUUCUAAUGCUGGAGAGGA (SEQ ID NO: 869) | 20 | upstream |
| CEP290-1109 | + | CUAAUGCUGGAGAGGAUAGGACA (SEQ ID NO: 1916) | 23 | upstream |
| CEP290-1110 | − | CAUAAGUUACAAUCUGUGAAU (SEQ ID NO: 1917) | 21 | upstream |
| CEP290-1111 | − | CCAGACAUCUAAGAGAAAA (SEQ ID NO: 1918) | 19 | upstream |
| CEP290-1112 | − | CAGACAUCUAAGAGAAAA (SEQ ID NO: 1919) | 18 | upstream |
| CEP290-1113 | + | CCUCUAUUUCUGAUGAGGAAG (SEQ ID NO: 1920) | 21 | upstream |
| CEP290-1114 | + | CUCUAUUUCUGAUGAGGAAG (SEQ ID NO: 866) | 20 | upstream |
| CEP290-1115 | + | CUAUUUCUGAUGAGGAAG (SEQ ID NO: 1922) | 18 | upstream |
| CEP290-1116 | + | CUGAUGAGGAAGAUGAACAAAUC (SEQ ID NO: 1923) | 23 | upstream |
| CEP290-1117 | + | CAUUUACUGAAUGUGUCUCU (SEQ ID NO: 856) | 20 | upstream |
| CEP290-1118 | + | CAGGGGUAAGAGAAAGGG (SEQ ID NO: 1925) | 18 | upstream |
| CEP290-1119 | + | GUUGGCUACAUCCAUUCCA (SEQ ID NO: 1926) | 19 | upstream |
| CEP290-1120 | − | GUAGUUAUCUUACAGCCAC (SEQ ID NO: 1927) | 19 | upstream |

TABLE 9E-continued

| gRNA Name | DNA Strand | Targeting Domain | Target Site Length | Position relative to mutation |
|---|---|---|---|---|
| CEP290-1121 | + | GUCUCUAUGAGCCAGCAAAAGCUU (SEQ ID NO: 1928) | 24 | upstream |
| CEP290-1122 | + | GAGUGCAUCCAUGGUCCAGG (SEQ ID NO: 1929) | 20 | upstream |
| CEP290-1123 | + | GUGCAUCCAUGGUCCAGG (SEQ ID NO: 1930) | 18 | upstream |
| CEP290-1124 | − | GCUGAAAUAUUAAGGGCUCUUC (SEQ ID NO: 1931) | 22 | upstream |
| CEP290-1125 | − | GAAAUAUUAAGGGCUCUUC (SEQ ID NO: 1932) | 19 | upstream |
| CEP290-1126 | − | GAACUCUAUACCUUUUACUGAGGA (SEQ ID NO: 1933) | 24 | upstream |
| CEP290-1127 | − | GAACUCUAUACCUUUUACU (SEQ ID NO: 1934) | 19 | upstream |
| CEP290-1128 | + | GUAGGAAUCCUGAAAGCUACU (SEQ ID NO: 1935) | 21 | upstream |
| CEP290-1129 | + | GGAAUCCUGAAAGCUACU (SEQ ID NO: 1936) | 18 | upstream |
| CEP290-1130 | − | GUAGCCAACAGUAGCUGAAAUAUU (SEQ ID NO: 1937) | 24 | upstream |
| CEP290-1131 | − | GCCAACAGUAGCUGAAAUAUU (SEQ ID NO: 1938) | 21 | upstream |
| CEP290-1132 | + | GGACUUUCUAAUGCUGGAGAGGA (SEQ ID NO: 1939) | 23 | upstream |
| CEP290-1133 | + | GACUUUCUAAUGCUGGAGAGGA (SEQ ID NO: 1940) | 22 | upstream |
| CEP290-1134 | + | GCUGGAGAGGAUAGGACA (SEQ ID NO: 1941) | 18 | upstream |
| CEP290-1135 | + | GCCUCUAUUUCUGAUGAGGAAG (SEQ ID NO: 1942) | 22 | upstream |
| CEP290-1136 | + | GAUGAGGAAGAUGAACAAAUC (SEQ ID NO: 1943) | 21 | upstream |
| CEP290-1137 | + | GAGGAAGAUGAACAAAUC (SEQ ID NO: 1944) | 18 | upstream |
| CEP290-1138 | + | GGGUACAGGGGUAAGAGAAAGGG (SEQ ID NO: 1945) | 23 | upstream |
| CEP290-1139 | + | GGUACAGGGGUAAGAGAAAGGG (SEQ ID NO: 1946) | 22 | upstream |
| CEP290-1140 | + | GUACAGGGGUAAGAGAAAGGG (SEQ ID NO: 1947) | 21 | upstream |
| CEP290-1141 | + | GUGUGUGUGUGUGUGUUAUGU (SEQ ID NO: 1948) | 23 | upstream |
| CEP290-1142 | + | GUGUGUGUGUGUGUGUUAUGU (SEQ ID NO: 1949) | 21 | upstream |
| CEP290-1143 | + | GUGUGUGUGUGUGUUAUGU (SEQ ID NO: 1950) | 19 | upstream |
| CEP290-1144 | + | UACUGUUGGCUACAUCCAUUCCA (SEQ ID NO: 1951) | 23 | upstream |
| CEP290-1145 | + | UGUUGGCUACAUCCAUUCCA (SEQ ID NO: 1952) | 20 | upstream |

TABLE 9E-continued

| gRNA Name | DNA Strand | Targeting Domain | Target Site Length | Position relative to mutation |
|---|---|---|---|---|
| CEP290-1146 | + | UUGGCUACAUCCAUUCCA (SEQ ID NO: 1953) | 18 | upstream |
| CEP290-1147 | + | UUAUCCACAAGAUGUCUCUUGCC (SEQ ID NO: 1954) | 23 | upstream |
| CEP290-1148 | + | UAUCCACAAGAUGUCUCUUGCC (SEQ ID NO: 1955) | 22 | upstream |
| CEP290-1149 | + | UCCACAAGAUGUCUCUUGCC (SEQ ID NO: 885) | 20 | upstream |
| CEP290-1150 | − | UUUGUAGUUAUCUUACAGCCAC (SEQ ID NO: 1957) | 22 | upstream |
| CEP290-1151 | − | UUGUAGUUAUCUUACAGCCAC (SEQ ID NO: 1958) | 21 | upstream |
| CEP290-1152 | − | UGUAGUUAUCUUACAGCCAC (SEQ ID NO: 1959) | 20 | upstream |
| CEP290-1153 | − | UAGUUAUCUUACAGCCAC (SEQ ID NO: 1960) | 18 | upstream |
| CEP290-1154 | + | UCUCUAUGAGCCAGCAAAAGCUU (SEQ ID NO: 1961) | 23 | upstream |
| CEP290-1155 | + | UCUAUGAGCCAGCAAAAGCUU (SEQ ID NO: 1962) | 21 | upstream |
| CEP290-1156 | + | UAUGAGCCAGCAAAAGCUU (SEQ ID NO: 1963) | 19 | upstream |
| CEP290-1157 | + | UACAGAGUGCAUCCAUGGUCCAGG (SEQ ID NO: 1964) | 24 | upstream |
| CEP290-1158 | − | UAGCUGAAAUAUUAAGGGCUCUUC (SEQ ID NO: 1965) | 24 | upstream |
| CEP290-1159 | − | UGAAAUAUUAAGGGCUCUUC (SEQ ID NO: 1966) | 20 | upstream |
| CEP290-1160 | − | UCUAUACCUUUUACUGAGGA (SEQ ID NO: 889) | 20 | upstream |
| CEP290-1161 | − | UAUACCUUUUACUGAGGA (SEQ ID NO: 1968) | 18 | upstream |
| CEP290-1162 | − | UUGAACUCUAUACCUUUUACU (SEQ ID NO: 1969) | 21 | upstream |
| CEP290-1163 | − | UGAACUCUAUACCUUUUACU (SEQ ID NO: 1970) | 20 | upstream |
| CEP290-1164 | + | UUAGUAGGAAUCCUGAAAGCUACU (SEQ ID NO: 1971) | 24 | upstream |
| CEP290-1165 | + | UAGUAGGAAUCCUGAAAGCUACU (SEQ ID NO: 1972) | 23 | upstream |
| CEP290-1166 | + | UAGGAAUCCUGAAAGCUACU (SEQ ID NO: 760) | 20 | upstream |
| CEP290-1167 | − | UAGCCAACAGUAGCUGAAAUAUU (SEQ ID NO: 1974) | 23 | upstream |
| CEP290-1168 | + | UCCAUUCCAAGGAACAAAAGCC (SEQ ID NO: 1975) | 22 | upstream |
| CEP290-1169 | + | UUCCAAGGAACAAAAGCC (SEQ ID NO: 1976) | 18 | upstream |
| CEP290-1170 | − | UCCCUUUCUCUUACCCCUGUACC (SEQ ID NO: 1977) | 23 | upstream |

TABLE 9E-continued

| gRNA Name | DNA Strand | Targeting Domain | Target Site Length | Position relative to mutation |
|---|---|---|---|---|
| CEP290-1171 | − | UUUCUCUUACCCCUGUACC (SEQ ID NO: 1978) | 19 | upstream |
| CEP290-1172 | − | UUCUCUUACCCCUGUACC (SEQ ID NO: 1979) | 18 | upstream |
| CEP290-1173 | + | UUUCUAAUGCUGGAGAGGA (SEQ ID NO: 1980) | 19 | upstream |
| CEP290-1174 | + | UUCUAAUGCUGGAGAGGA (SEQ ID NO: 1981) | 18 | upstream |
| CEP290-1175 | + | UCUAAUGCUGGAGAGGAUAGGACA (SEQ ID NO: 1982) | 24 | upstream |
| CEP290-1176 | + | UAAUGCUGGAGAGGAUAGGACA (SEQ ID NO: 1983) | 22 | upstream |
| CEP290-1177 | + | UGCUGGAGAGGAUAGGACA (SEQ ID NO: 1984) | 19 | upstream |
| CEP290-1178 | − | UAUCAUAAGUUACAAUCUGUGAAU (SEQ ID NO: 1985) | 24 | upstream |
| CEP290-1179 | − | UCAUAAGUUACAAUCUGUGAAU (SEQ ID NO: 1986) | 22 | upstream |
| CEP290-1180 | − | UAAGUUACAAUCUGUGAAU (SEQ ID NO: 1987) | 19 | upstream |
| CEP290-1181 | − | UUUAACCAGACAUCUAAGAGAAAA (SEQ ID NO: 1988) | 24 | upstream |
| CEP290-1182 | − | UUAACCAGACAUCUAAGAGAAAA (SEQ ID NO: 1989) | 23 | upstream |
| CEP290-1183 | − | UAACCAGACAUCUAAGAGAAAA (SEQ ID NO: 1990) | 22 | upstream |
| CEP290-1184 | + | UCUAUUUCUGAUGAGGAAG (SEQ ID NO: 1991) | 19 | upstream |
| CEP290-1185 | + | UCUGAUGAGGAAGAUGAACAAAUC (SEQ ID NO: 1992) | 24 | upstream |
| CEP290-1186 | + | UGAUGAGGAAGAUGAACAAAUC (SEQ ID NO: 1993) | 22 | upstream |
| CEP290-1187 | + | UGAGGAAGAUGAACAAAUC (SEQ ID NO: 1994) | 19 | upstream |
| CEP290-1188 | + | UUUUCAUUUACUGAAUGUGUCUCU (SEQ ID NO: 1995) | 24 | upstream |
| CEP290-1189 | + | UUUCAUUUACUGAAUGUGUCUCU (SEQ ID NO: 1996) | 23 | upstream |
| CEP290-1190 | + | UUCAUUUACUGAAUGUGUCUCU (SEQ ID NO: 1997) | 22 | upstream |
| CEP290-1191 | + | UCAUUUACUGAAUGUGUCUCU (SEQ ID NO: 1998) | 21 | upstream |
| CEP290-1192 | + | UUUACUGAAUGUGUCUCU (SEQ ID NO: 1999) | 18 | upstream |
| CEP290-1193 | + | UGGGUACAGGGGUAAGAGAAAGGG (SEQ ID NO: 2000) | 24 | upstream |
| CEP290-1194 | + | UACAGGGGUAAGAGAAAGGG (SEQ ID NO: 2001) | 20 | upstream |
| CEP290-1195 | + | UGUGUGUGUGUGUGUGUUAUGU (SEQ ID NO: 2002) | 24 | upstream |

TABLE 9E-continued

| gRNA Name | DNA Strand | Targeting Domain | Target Site Length | Position relative to mutation |
|---|---|---|---|---|
| CEP290-1196 | + | UGUGUGUGUGUGUGUUAUGU (SEQ ID NO: 2003) | 22 | upstream |
| CEP290-1197 | + | UGUGUGUGUGUGUUAUGU (SEQ ID NO: 1185) | 20 | upstream |
| CEP290-1198 | + | UGUGUGUGUGUUAUGU (SEQ ID NO: 2005) | 18 | upstream |
| CEP290-1199 | + | AUUUACAGAGUGCAUCCAUGGUCC (SEQ ID NO: 2006) | 24 | upstream |
| CEP290-1200 | + | ACAGAGUGCAUCCAUGGUCC (SEQ ID NO: 1085) | 20 | upstream |
| CEP290-1201 | + | AGAGUGCAUCCAUGGUCC (SEQ ID NO: 2008) | 18 | upstream |
| CEP290-1202 | − | ACUUGAACUCUAUACCUUUUA (SEQ ID NO: 2009) | 21 | upstream |
| CEP290-1203 | + | AGCUAAAUCAUGCAAGUGACCU (SEQ ID NO: 2010) | 22 | upstream |
| CEP290-1204 | + | AAAUCAUGCAAGUGACCU (SEQ ID NO: 2011) | 18 | upstream |
| CEP290-1205 | + | AUCCAUAAGCCUCUAUUUCUGAUG (SEQ ID NO: 2012) | 24 | upstream |
| CEP290-1206 | + | AUAAGCCUCUAUUUCUGAUG (SEQ ID NO: 723) | 20 | upstream |
| CEP290-1207 | + | AAGCCUCUAUUUCUGAUG (SEQ ID NO: 2014) | 18 | upstream |
| CEP290-1208 | + | AGAAUAGUUUGUUCUGGGUA (SEQ ID NO: 2015) | 20 | upstream |
| CEP290-1209 | + | AAUAGUUUGUUCUGGGUA (SEQ ID NO: 2016) | 18 | upstream |
| CEP290-1210 | + | AGGAGAAUGAUCUAGAUAAUCAUU (SEQ ID NO: 2017) | 24 | upstream |
| CEP290-1211 | + | AGAAUGAUCUAGAUAAUCAUU (SEQ ID NO: 2018) | 21 | upstream |
| CEP290-1212 | + | AAUGAUCUAGAUAAUCAUU (SEQ ID NO: 2019) | 19 | upstream |
| CEP290-1213 | + | AUGAUCUAGAUAAUCAUU (SEQ ID NO: 2020) | 18 | upstream |
| CEP290-1214 | + | AAUGCUGGAGAGGAUAGGA (SEQ ID NO: 2021) | 19 | upstream |
| CEP290-1215 | + | AUGCUGGAGAGGAUAGGA (SEQ ID NO: 2022) | 18 | upstream |
| CEP290-1216 | + | AAAAUCCAUAAGCCUCUAUUUCUG (SEQ ID NO: 2023) | 24 | upstream |
| CEP290-1217 | + | AAAUCCAUAAGCCUCUAUUUCUG (SEQ ID NO: 2024) | 23 | upstream |
| CEP290-1218 | + | AAUCCAUAAGCCUCUAUUUCUG (SEQ ID NO: 2025) | 22 | upstream |
| CEP290-1219 | + | AUCCAUAAGCCUCUAUUUCUG (SEQ ID NO: 2026) | 21 | upstream |
| CEP290-1220 | − | AAACAGGUAGAAUAUUGUAAUCA (SEQ ID NO: 2027) | 23 | upstream |

TABLE 9E-continued

| gRNA Name | DNA Strand | Targeting Domain | Target Site Length | Position relative to mutation |
|---|---|---|---|---|
| CEP290-1221 | − | AACAGGUAGAAUAUUGUAAUCA (SEQ ID NO: 2028) | 22 | upstream |
| CEP290-1222 | − | ACAGGUAGAAUAUUGUAAUCA (SEQ ID NO: 2029) | 21 | upstream |
| CEP290-1223 | − | AGGUAGAAUAUUGUAAUCA (SEQ ID NO: 2030) | 19 | upstream |
| CEP290-1224 | + | AAGGAACAAAAGCCAGGGACCA (SEQ ID NO: 2031) | 22 | upstream |
| CEP290-1225 | + | AGGAACAAAAGCCAGGGACCA (SEQ ID NO: 2032) | 21 | upstream |
| CEP290-1226 | + | AACAAAAGCCAGGGACCA (SEQ ID NO: 2033) | 18 | upstream |
| CEP290-1227 | − | AGGUAGAAUAUUGUAAUCAAGGA (SEQ ID NO: 2034) | 24 | upstream |
| CEP290-1228 | − | AGAAUAUUGUAAUCAAAGGA (SEQ ID NO: 1089) | 20 | upstream |
| CEP290-1229 | − | AAUAUUGUAAUCAAAGGA (SEQ ID NO: 2036) | 18 | upstream |
| CEP290-1230 | − | AGUCAUGUUUAUCAAUAUUAUU (SEQ ID NO: 2037) | 22 | upstream |
| CEP290-1231 | − | AUGUUUAUCAAUAUUAUU (SEQ ID NO: 2038) | 18 | upstream |
| CEP290-1232 | − | AACCAGACAUCUAAGAGAAA (SEQ ID NO: 2039) | 20 | upstream |
| CEP290-1233 | − | ACCAGACAUCUAAGAGAAA (SEQ ID NO: 2040) | 19 | upstream |
| CEP290-1234 | − | AUUCUUAUCUAAGAUCCUUUCA (SEQ ID NO: 2041) | 22 | upstream |
| CEP290-1235 | − | AAACAGGUAGAAUAUUGUAAUCAA (SEQ ID NO: 2042) | 24 | upstream |
| CEP290-1236 | − | AACAGGUAGAAUAUUGUAAUCAA (SEQ ID NO: 2043) | 23 | upstream |
| CEP290-1237 | − | ACAGGUAGAAUAUUGUAAUCAA (SEQ ID NO: 2044) | 22 | upstream |
| CEP290-1238 | − | AGGUAGAAUAUUGUAAUCAA (SEQ ID NO: 1101) | 20 | upstream |
| CEP290-1239 | + | AUGAGGAAGAUGAACAAAU (SEQ ID NO: 2046) | 19 | upstream |
| CEP290-1240 | + | AGAGGAUAGGACAGAGGAC (SEQ ID NO: 2047) | 19 | upstream |
| CEP290-1241 | + | CAGAGUGCAUCCAUGGUCC (SEQ ID NO: 2048) | 19 | upstream |
| CEP290-1242 | + | CUUGCCUAGGACUUUCUAAUGCUG (SEQ ID NO: 2049) | 24 | upstream |
| CEP290-1243 | + | CCUAGGACUUUCUAAUGCUG (SEQ ID NO: 858) | 20 | upstream |
| CEP290-1244 | + | CUAGGACUUUCUAAUGCUG (SEQ ID NO: 2051) | 19 | upstream |
| CEP290-1245 | − | CCACUUGAACUCUAUACCUUUA (SEQ ID NO: 2052) | 23 | upstream |

TABLE 9E-continued

| gRNA Name | DNA Strand | Targeting Domain | Target Site Length | Position relative to mutation |
|---|---|---|---|---|
| CEP290-1246 | − | CACUUGAACUCUAUACCUUUUA (SEQ ID NO: 2053) | 22 | upstream |
| CEP290-1247 | − | CUUGAACUCUAUACCUUUUA (SEQ ID NO: 2054) | 20 | upstream |
| CEP290-1248 | + | CAGCUAAAUCAUGCAAGUGACCU (SEQ ID NO: 2055) | 23 | upstream |
| CEP290-1249 | + | CUAAAUCAUGCAAGUGACCU (SEQ ID NO: 2056) | 20 | upstream |
| CEP290-1250 | + | CUCUUGCCUAGGACUUUCUAAUG (SEQ ID NO: 2057) | 23 | upstream |
| CEP290-1251 | + | CUUGCCUAGGACUUUCUAAUG (SEQ ID NO: 2058) | 21 | upstream |
| CEP290-1252 | + | CCAUAAGCCUCUAUUUCUGAUG (SEQ ID NO: 2059) | 22 | upstream |
| CEP290-1253 | + | CAUAAGCCUCUAUUUCUGAUG (SEQ ID NO: 2060) | 21 | upstream |
| CEP290-1254 | + | CUAAUGCUGGAGAGGAUAGGA (SEQ ID NO: 2061) | 21 | upstream |
| CEP290-1255 | + | CCAUAAGCCUCUAUUUCUG (SEQ ID NO: 2062) | 19 | upstream |
| CEP290-1256 | + | CAUAAGCCUCUAUUUCUG (SEQ ID NO: 2063) | 18 | upstream |
| CEP290-1257 | − | CAGGUAGAAUAUUGUAAUCA (SEQ ID NO: 2064) | 20 | upstream |
| CEP290-1258 | − | CUUUCUGCUGCUUUUGCCAAA (SEQ ID NO: 2065) | 21 | upstream |
| CEP290-1259 | + | CCAAGGAACAAAAGCCAGGGACCA (SEQ ID NO: 2066) | 24 | upstream |
| CEP290-1260 | + | CAAGGAACAAAAGCCAGGGACCA (SEQ ID NO: 2067) | 23 | upstream |
| CEP290-1261 | + | CUCUUAGAUGUCUGGUUAA (SEQ ID NO: 2068) | 19 | upstream |
| CEP290-1262 | − | CAUGUUUAUCAAUAUUAUU (SEQ ID NO: 2069) | 19 | upstream |
| CEP290-1263 | − | CCAGACAUCUAAGAGAAA (SEQ ID NO: 2070) | 18 | upstream |
| CEP290-1264 | − | CUUAUCUAAGAUCCUUUCA (SEQ ID NO: 2071) | 19 | upstream |
| CEP290-1265 | − | CAGGUAGAAUAUUGUAAUCAA (SEQ ID NO: 2072) | 21 | upstream |
| CEP290-1266 | + | CUGAUGAGGAAGAUGAACAAAU (SEQ ID NO: 2073) | 22 | upstream |
| CEP290-1267 | + | CUGGAGAGGAUAGGACAGAGGAC (SEQ ID NO: 2074) | 23 | upstream |
| CEP290-1268 | − | CAUCUUCCUCAUCAGAAA (SEQ ID NO: 2075) | 18 | upstream |
| CEP290-1269 | + | GCCUAGGACUUUCUAAUGCUG (SEQ ID NO: 2076) | 21 | upstream |
| CEP290-1270 | − | GCCACUUGAACUCUAUACCUUUUA (SEQ ID NO: 2077) | 24 | upstream |

TABLE 9E-continued

| gRNA Name | DNA Strand | Targeting Domain | Target Site Length | Position relative to mutation |
|---|---|---|---|---|
| CEP290-1271 | + | GCUAAAUCAUGCAAGUGACCU (SEQ ID NO: 2078) | 21 | upstream |
| CEP290-1272 | + | GCCUAGGACUUUCUAAUG (SEQ ID NO: 2079) | 18 | upstream |
| CEP290-1273 | + | GGGAGAAUAGUUUGUUCUGGGUA (SEQ ID NO: 2080) | 23 | upstream |
| CEP290-1274 | + | GGAGAAUAGUUUGUUCUGGGUA (SEQ ID NO: 2081) | 22 | upstream |
| CEP290-1275 | + | GAGAAUAGUUUGUUCUGGGUA (SEQ ID NO: 2082) | 21 | upstream |
| CEP290-1276 | + | GAAUAGUUUGUUCUGGGUA (SEQ ID NO: 2083) | 19 | upstream |
| CEP290-1277 | + | GGAGAAUGAUCUAGAUAAUCAUU (SEQ ID NO: 2084) | 23 | upstream |
| CEP290-1278 | + | GAGAAUGAUCUAGAUAAUCAUU (SEQ ID NO: 2085) | 22 | upstream |
| CEP290-1279 | + | GAAUGAUCUAGAUAAUCAUU (SEQ ID NO: 2086) | 20 | upstream |
| CEP290-1280 | − | GAAACAGGUAGAAUAUUGUAAUCA (SEQ ID NO: 2087) | 24 | upstream |
| CEP290-1281 | − | GGUAGAAUAUUGUAAUCA (SEQ ID NO: 2088) | 18 | upstream |
| CEP290-1282 | − | GCUUUCUGCUGCUUUUGCCAAA (SEQ ID NO: 2089) | 22 | upstream |
| CEP290-1283 | + | GGAACAAAAGCCAGGGACCA (SEQ ID NO: 484) | 20 | upstream |
| CEP290-1284 | + | GAACAAAAGCCAGGGACCA (SEQ ID NO: 2090) | 19 | upstream |
| CEP290-1285 | − | GGUAGAAUAUUGUAAUCAAAGGA (SEQ ID NO: 2091) | 23 | upstream |
| CEP290-1286 | − | GUAGAAUAUUGUAAUCAAAGGA (SEQ ID NO: 2092) | 22 | upstream |
| CEP290-1287 | − | GAAUAUUGUAAUCAAAGGA (SEQ ID NO: 2093) | 19 | upstream |
| CEP290-1288 | − | GAGUCAUGUUUAUCAAUAUUAUU (SEQ ID NO: 2094) | 23 | upstream |
| CEP290-1289 | − | GUCAUGUUUAUCAAUAUUAUU (SEQ ID NO: 2095) | 21 | upstream |
| CEP290-1290 | − | GGUAGAAUAUUGUAAUCAA (SEQ ID NO: 2096) | 19 | upstream |
| CEP290-1291 | − | GUAGAAUAUUGUAAUCAA (SEQ ID NO: 2097) | 18 | upstream |
| CEP290-1292 | + | GAUGAGGAAGAUGAACAAAU (SEQ ID NO: 773) | 20 | upstream |
| CEP290-1293 | + | GCUGGAGAGGAUAGGACAGAGGAC (SEQ ID NO: 2099) | 24 | upstream |
| CEP290-1294 | + | GGAGAGGAUAGGACAGAGGAC (SEQ ID NO: 2100) | 21 | upstream |
| CEP290-1295 | + | GAGAGGAUAGGACAGAGGAC (SEQ ID NO: 772) | 20 | upstream |

TABLE 9E-continued

| gRNA Name | DNA Strand | Targeting Domain | Target Site Length | Position relative to mutation |
|---|---|---|---|---|
| CEP290-1296 | + | GAGGAUAGGACAGAGGAC (SEQ ID NO: 2102) | 18 | upstream |
| CEP290-1297 | − | GUUCAUCUUCCUCAUCAGAAA (SEQ ID NO: 2103) | 21 | upstream |
| CEP290-1298 | + | UUUACAGAGUGCAUCCAUGGUCC (SEQ ID NO: 2104) | 23 | upstream |
| CEP290-1299 | + | UUACAGAGUGCAUCCAUGGUCC (SEQ ID NO: 2105) | 22 | upstream |
| CEP290-1300 | + | UACAGAGUGCAUCCAUGGUCC (SEQ ID NO: 2106) | 21 | upstream |
| CEP290-1301 | + | UUGCCUAGGACUUUCUAAUGCUG (SEQ ID NO: 2107) | 23 | upstream |
| CEP290-1302 | + | UGCCUAGGACUUUCUAAUGCUG (SEQ ID NO: 2108) | 22 | upstream |
| CEP290-1303 | + | UAGGACUUUCUAAUGCUG (SEQ ID NO: 2109) | 18 | upstream |
| CEP290-1304 | − | UUGAACUCUAUACCUUUUA (SEQ ID NO: 2110) | 19 | upstream |
| CEP290-1305 | − | UGAACUCUAUACCUUUUA (SEQ ID NO: 2111) | 18 | upstream |
| CEP290-1306 | + | UCAGCUAAAUCAUGCAAGUGACCU (SEQ ID NO: 2112) | 24 | upstream |
| CEP290-1307 | + | UAAAUCAUGCAAGUGACCU (SEQ ID NO: 2113) | 19 | upstream |
| CEP290-1308 | + | UCUCUUGCCUAGGACUUUCUAAUG (SEQ ID NO: 2114) | 24 | upstream |
| CEP290-1309 | + | UCUUGCCUAGGACUUUCUAAUG (SEQ ID NO: 2115) | 22 | upstream |
| CEP290-1310 | + | UUGCCUAGGACUUUCUAAUG (SEQ ID NO: 906) | 20 | upstream |
| CEP290-1311 | + | UGCCUAGGACUUUCUAAUG (SEQ ID NO: 2117) | 19 | upstream |
| CEP290-1312 | + | UCCAUAAGCCUCUAUUUCUGAUG (SEQ ID NO: 2118) | 23 | upstream |
| CEP290-1313 | + | UAAGCCUCUAUUUCUGAUG (SEQ ID NO: 2119) | 19 | upstream |
| CEP290-1314 | + | UGGGAGAAUAGUUUGUUCUGGGUA (SEQ ID NO: 2120) | 24 | upstream |
| CEP290-1315 | + | UUUCUAAUGCUGGAGAGGAUAGGA (SEQ ID NO: 2121) | 24 | upstream |
| CEP290-1316 | + | UUCUAAUGCUGGAGAGGAUAGGA (SEQ ID NO: 2122) | 23 | upstream |
| CEP290-1317 | + | UCUAAUGCUGGAGAGGAUAGGA (SEQ ID NO: 2123) | 22 | upstream |
| CEP290-1318 | + | UAAUGCUGGAGAGGAUAGGA (SEQ ID NO: 873) | 20 | upstream |
| CEP290-1319 | + | UCCAUAAGCCUCUAUUUCUG (SEQ ID NO: 886) | 20 | upstream |
| CEP290-1320 | − | UUGCUUUCUGCUGCUUUUGCCAAA (SEQ ID NO: 2126) | 24 | upstream |

TABLE 9E-continued

| gRNA Name | DNA Strand | Targeting Domain | Target Site Length | Position relative to mutation |
|---|---|---|---|---|
| CEP290-1321 | − | UGCUUUCUGCUGCUUUUGCCAAA (SEQ ID NO: 2127) | 23 | upstream |
| CEP290-1322 | − | UUUCUGCUGCUUUUGCCAAA (SEQ ID NO: 907) | 20 | upstream |
| CEP290-1323 | − | UUCUGCUGCUUUUGCCAAA (SEQ ID NO: 2129) | 19 | upstream |
| CEP290-1324 | − | UCUGCUGCUUUUGCCAAA (SEQ ID NO: 2130) | 18 | upstream |
| CEP290-1325 | − | UAGAAUAUUGUAAUCAAAGGA (SEQ ID NO: 2131) | 21 | upstream |
| CEP290-1326 | + | UUUUUCUCUUAGAUGUCUGGUUAA (SEQ ID NO: 2132) | 24 | upstream |
| CEP290-1327 | + | UUUUCUCUUAGAUGUCUGGUUAA (SEQ ID NO: 2133) | 23 | upstream |
| CEP290-1328 | + | UUUCUCUUAGAUGUCUGGUUAA (SEQ ID NO: 2134) | 22 | upstream |
| CEP290-1329 | + | UUCUCUUAGAUGUCUGGUUAA (SEQ ID NO: 2135) | 21 | upstream |
| CEP290-1330 | + | UCUCUUAGAUGUCUGGUUAA (SEQ ID NO: 2136) | 20 | upstream |
| CEP290-1331 | + | UCUUAGAUGUCUGGUUAA (SEQ ID NO: 2137) | 18 | upstream |
| CEP290-1332 | − | UGAGUCAUGUUUAUCAAUAUUAUU (SEQ ID NO: 2138) | 24 | upstream |
| CEP290-1333 | − | UCAUGUUUAUCAAUAUUAUU (SEQ ID NO: 884) | 20 | upstream |
| CEP290-1334 | − | UUUUAACCAGACAUCUAAGAGAAA (SEQ ID NO: 2140) | 24 | upstream |
| CEP290-1335 | − | UUUAACCAGACAUCUAAGAGAAA (SEQ ID NO: 2141) | 23 | upstream |
| CEP290-1336 | − | UUAACCAGACAUCUAAGAGAAA (SEQ ID NO: 2142) | 22 | upstream |
| CEP290-1337 | − | UAACCAGACAUCUAAGAGAAA (SEQ ID NO: 2143) | 21 | upstream |
| CEP290-1338 | − | UUAUUCUUAUCUAAGAUCCUUUCA (SEQ ID NO: 2144) | 24 | upstream |
| CEP290-1339 | − | UAUUCUUAUCUAAGAUCCUUUCA (SEQ ID NO: 2145) | 23 | upstream |
| CEP290-1340 | − | UUCUUAUCUAAGAUCCUUUCA (SEQ ID NO: 2146) | 21 | upstream |
| CEP290-1341 | − | UCUUAUCUAAGAUCCUUUCA (SEQ ID NO: 892) | 20 | upstream |
| CEP290-1342 | − | UUAUCUAAGAUCCUUUCA (SEQ ID NO: 2148) | 18 | upstream |
| CEP290-1343 | + | UUCUGAUGAGGAAGAUGAACAAAU (SEQ ID NO: 2149) | 24 | upstream |
| CEP290-1344 | + | UCUGAUGAGGAAGAUGAACAAAU (SEQ ID NO: 2150) | 23 | upstream |
| CEP290-1345 | + | UGAUGAGGAAGAUGAACAAAU (SEQ ID NO: 2151) | 21 | upstream |

TABLE 9E-continued

| gRNA Name | DNA Strand | Targeting Domain | Target Site Length | Position relative to mutation |
|---|---|---|---|---|
| CEP290-1346 | + | UGAGGAAGAUGAACAAAU (SEQ ID NO: 2152) | 18 | upstream |
| CEP290-1347 | + | UGGAGAGGAUAGGACAGAGGAC (SEQ ID NO: 2153) | 22 | upstream |
| CEP290-1348 | − | UUUGUUCAUCUUCCUCAUCAGAAA (SEQ ID NO: 2154) | 24 | upstream |
| CEP290-1349 | − | UUGUUCAUCUUCCUCAUCAGAAA (SEQ ID NO: 2155) | 23 | upstream |
| CEP290-1350 | − | UGUUCAUCUUCCUCAUCAGAAA (SEQ ID NO: 2156) | 22 | upstream |
| CEP290-1351 | − | UUCAUCUUCCUCAUCAGAAA (SEQ ID NO: 905) | 20 | upstream |
| CEP290-1352 | − | UCAUCUUCCUCAUCAGAAA (SEQ ID NO: 2158) | 19 | upstream |
| CEP290-1353 | − | ACUUACCUCAUGUCAUCUAGAGC (SEQ ID NO: 2159) | 23 | downstream |
| CEP290-1354 | − | ACCUCAUGUCAUCUAGAGC (SEQ ID NO: 2160) | 19 | downstream |
| CEP290-1355 | + | ACAGUUUUUAAGGCGGGGAGUCAC (SEQ ID NO: 2161) | 24 | downstream |
| CEP290-1356 | + | AGUUUUUAAGGCGGGGAGUCAC (SEQ ID NO: 2162) | 22 | downstream |
| CEP290-1357 | − | ACAGAGUUCAAGCUAAUAC (SEQ ID NO: 2163) | 19 | downstream |
| CEP290-1358 | + | AUUAGCUUGAACUCUGUGCCAAAC (SEQ ID NO: 2164) | 24 | downstream |
| CEP290-1359 | + | AGCUUGAACUCUGUGCCAAAC (SEQ ID NO: 2165) | 21 | downstream |
| CEP290-1360 | − | AUGUGGUGUCAAAUAUGGUGCU (SEQ ID NO: 2166) | 22 | downstream |
| CEP290-1361 | − | AUGUGGUGUCAAAUAUGGUGCUU (SEQ ID NO: 2167) | 23 | downstream |
| CEP290-1362 | + | AGAUGACAUGAGGUAAGU (SEQ ID NO: 2168) | 18 | downstream |
| CEP290-1363 | − | AAUACAUGAGAGUGAUUAGUGG (SEQ ID NO: 2169) | 22 | downstream |
| CEP290-1364 | − | AUACAUGAGAGUGAUUAGUGG (SEQ ID NO: 2170) | 21 | downstream |
| CEP290-1365 | − | ACAUGAGAGUGAUUAGUGG (SEQ ID NO: 2171) | 19 | downstream |
| CEP290-16 | + | AAGACACUGCCAAUAGGGAUAGGU (SEQ ID NO: 1042) | 24 | downstream |
| CEP290-1366 | + | AGACACUGCCAAUAGGGAUAGGU (SEQ ID NO: 1043) | 23 | downstream |
| CEP290-1367 | + | ACACUGCCAAUAGGGAUAGGU (SEQ ID NO: 1044) | 21 | downstream |
| CEP290-510 | + | ACUGCCAAUAGGGAUAGGU (SEQ ID NO: 1045) | 19 | downstream |
| CEP290-1368 | − | AAAGGUUCAUGAGACUAGAGGUC (SEQ ID NO: 2176) | 23 | downstream |

TABLE 9E-continued

| gRNA Name | DNA Strand | Targeting Domain | Target Site Length | Position relative to mutation |
|---|---|---|---|---|
| CEP290-1369 | − | AAGGUUCAUGAGACUAGAGGUC (SEQ ID NO: 2177) | 22 | downstream |
| CEP290-1370 | − | AGGUUCAUGAGACUAGAGGUC (SEQ ID NO: 2178) | 21 | downstream |
| CEP290-1371 | + | AAACAGGAGAUACUCAACACA (SEQ ID NO: 2179) | 21 | downstream |
| CEP290-1372 | + | AACAGGAGAUACUCAACACA (SEQ ID NO: 810) | 20 | downstream |
| CEP290-1373 | + | ACAGGAGAUACUCAACACA (SEQ ID NO: 2181) | 19 | downstream |
| CEP290-1374 | + | AGCACGUACAAAAGAACAUACAU (SEQ ID NO: 2182) | 23 | downstream |
| CEP290-1375 | + | ACGUACAAAAGAACAUACAU (SEQ ID NO: 817) | 20 | downstream |
| CEP290-1376 | + | AGUAAGGAGGAUGUAAGAC (SEQ ID NO: 2184) | 19 | downstream |
| CEP290-1377 | + | AGCUUUUGACAGUUUUUAAGG (SEQ ID NO: 2185) | 21 | downstream |
| CEP290-1378 | − | ACGUGCUCUUUUCUAUAUAU (SEQ ID NO: 622) | 20 | downstream |
| CEP290-1379 | + | AAAUUCACUGAGCAAAACAACUGG (SEQ ID NO: 2186) | 24 | downstream |
| CEP290-1380 | + | AAUUCACUGAGCAAAACAACUGG (SEQ ID NO: 2187) | 23 | downstream |
| CEP290-1381 | + | AUUCACUGAGCAAAACAACUGG (SEQ ID NO: 2188) | 22 | downstream |
| CEP290-1382 | + | ACUGAGCAAAACAACUGG (SEQ ID NO: 2189) | 18 | downstream |
| CEP290-1383 | + | AACAAGUUUUGAAACAGGAA (SEQ ID NO: 809) | 20 | downstream |
| CEP290-1384 | + | ACAAGUUUUGAAACAGGAA (SEQ ID NO: 2191) | 19 | downstream |
| CEP290-1385 | + | AAUGCCUGAACAAGUUUUGAAA (SEQ ID NO: 2192) | 22 | downstream |
| CEP290-1386 | + | AUGCCUGAACAAGUUUUGAAA (SEQ ID NO: 2193) | 21 | downstream |
| CEP290-1387 | + | AUUCACUGAGCAAAACAACUGGAA (SEQ ID NO: 2194) | 24 | downstream |
| CEP290-1388 | + | ACUGAGCAAAACAACUGGAA (SEQ ID NO: 819) | 20 | downstream |
| CEP290-1389 | + | AAAAAGGUAAUGCCUGAACAAGUU (SEQ ID NO: 2196) | 24 | downstream |
| CEP290-1390 | + | AAAAGGUAAUGCCUGAACAAGUU (SEQ ID NO: 2197) | 23 | downstream |
| CEP290-1391 | + | AAAGGUAAUGCCUGAACAAGUU (SEQ ID NO: 2198) | 22 | downstream |
| CEP290-1392 | + | AAGGUAAUGCCUGAACAAGUU (SEQ ID NO: 2199) | 21 | downstream |
| CEP290-1393 | + | AGGUAAUGCCUGAACAAGUU (SEQ ID NO: 828) | 20 | downstream |

TABLE 9E-continued

| gRNA Name | DNA Strand | Targeting Domain | Target Site Length | Position relative to mutation |
|---|---|---|---|---|
| CEP290-1394 | − | ACGUGCUCUUUUCUAUAUA (SEQ ID NO: 2201) | 19 | downstream |
| CEP290-1395 | + | AUUAUCUAUUCCAUUCUUCACAC (SEQ ID NO: 2202) | 23 | downstream |
| CEP290-1396 | + | AUCUAUUCCAUUCUUCACAC (SEQ ID NO: 2203) | 20 | downstream |
| CEP290-1397 | + | AAGAGAGAAAUGGUUCCCUAUAUA (SEQ ID NO: 2204) | 24 | downstream |
| CEP290-1398 | + | AGAGAGAAAUGGUUCCCUAUAUA (SEQ ID NO: 2205) | 23 | downstream |
| CEP290-1399 | + | AGAGAAAUGGUUCCCUAUAUA (SEQ ID NO: 2206) | 21 | downstream |
| CEP290-1400 | + | AGAAAUGGUUCCCUAUAUA (SEQ ID NO: 2207) | 19 | downstream |
| CEP290-1401 | − | AGGAAAUUAUUGUUGCUUU (SEQ ID NO: 2208) | 19 | downstream |
| CEP290-1402 | + | ACUGAGCAAAACAACUGGAAGA (SEQ ID NO: 2209) | 22 | downstream |
| CEP290-1403 | + | AGCAAAACAACUGGAAGA (SEQ ID NO: 2210) | 18 | downstream |
| CEP290-1404 | + | AUACAUAAGAAAGAACACUGUGGU (SEQ ID NO: 2211) | 24 | downstream |
| CEP290-1405 | + | ACAUAAGAAAGAACACUGUGGU (SEQ ID NO: 2212) | 22 | downstream |
| CEP290-1406 | + | AUAAGAAAGAACACUGUGGU (SEQ ID NO: 829) | 20 | downstream |
| CEP290-1407 | + | AAGAAAGAACACUGUGGU (SEQ ID NO: 2214) | 18 | downstream |
| CEP290-1408 | − | AAGAAUGGAAUAGAUAAU (SEQ ID NO: 2215) | 18 | downstream |
| CEP290-1409 | + | AAGGAGGAUGUAAGACUGGAGA (SEQ ID NO: 2216) | 22 | downstream |
| CEP290-1410 | + | AGGAGGAUGUAAGACUGGAGA (SEQ ID NO: 2217) | 21 | downstream |
| CEP290-1411 | + | AGGAUGUAAGACUGGAGA (SEQ ID NO: 2218) | 18 | downstream |
| CEP290-1412 | − | AAAAACUUGAAAUUUGAUAGUAG (SEQ ID NO: 2219) | 23 | downstream |
| CEP290-1413 | − | AAAACUUGAAAUUUGAUAGUAG (SEQ ID NO: 2220) | 22 | downstream |
| CEP290-1414 | − | AAACUUGAAAUUUGAUAGUAG (SEQ ID NO: 2221) | 21 | downstream |
| CEP290-1415 | − | AACUUGAAAUUUGAUAGUAG (SEQ ID NO: 2222) | 20 | downstream |
| CEP290-1416 | − | ACUUGAAAUUUGAUAGUAG (SEQ ID NO: 2223) | 19 | downstream |
| CEP290-1417 | − | ACAUAUCUGUCUUCCUUA (SEQ ID NO: 2224) | 18 | downstream |
| CEP290-1418 | + | AUUAAAAAAAGUAUGCUU (SEQ ID NO: 2225) | 18 | downstream |

TABLE 9E-continued

| gRNA Name | DNA Strand | Targeting Domain | Target Site Length | Position relative to mutation |
|---|---|---|---|---|
| CEP290-1419 | + | AUAUCAAAAGACUUAUAUUCCAUU (SEQ ID NO: 2226) | 24 | downstream |
| CEP290-1420 | + | AUCAAAAGACUUAUAUUCCAUU (SEQ ID NO: 2227) | 22 | downstream |
| CEP290-1421 | + | AAAAGACUUAUAUUCCAUU (SEQ ID NO: 2228) | 19 | downstream |
| CEP290-1422 | + | AAAGACUUAUAUUCCAUU (SEQ ID NO: 2229) | 18 | downstream |
| CEP290-1423 | − | AAAAUCAGAUUUCAUGUGUGAAGA (SEQ ID NO: 2230) | 24 | downstream |
| CEP290-1424 | − | AAAUCAGAUUUCAUGUGUGAAGA (SEQ ID NO: 2231) | 23 | downstream |
| CEP290-1425 | − | AAUCAGAUUUCAUGUGUGAAGA (SEQ ID NO: 2232) | 22 | downstream |
| CEP290-1426 | − | AUCAGAUUUCAUGUGUGAAGA (SEQ ID NO: 2233) | 21 | downstream |
| CEP290-1427 | − | AGAUUUCAUGUGUGAAGA (SEQ ID NO: 2234) | 18 | downstream |
| CEP290-1428 | − | AAUGGAAUAUAAGUCUUUUGAUAU (SEQ ID NO: 2235) | 24 | downstream |
| CEP290-1429 | − | AUGGAAUAUAAGUCUUUUGAUAU (SEQ ID NO: 2236) | 23 | downstream |
| CEP290-1430 | − | AAUAUAAGUCUUUUGAUAU (SEQ ID NO: 2237) | 19 | downstream |
| CEP290-1431 | − | AUAUAAGUCUUUUGAUAU (SEQ ID NO: 2238) | 18 | downstream |
| CEP290-1432 | − | AAGAAUGGAAUAGAUAAUA (SEQ ID NO: 2239) | 19 | downstream |
| CEP290-1433 | − | AGAAUGGAAUAGAUAAUA (SEQ ID NO: 2240) | 18 | downstream |
| CEP290-1434 | − | AAAACUGGAUGGGUAAUAAAGCAA (SEQ ID NO: 2241) | 24 | downstream |
| CEP290-1435 | − | AAACUGGAUGGGUAAUAAAGCAA (SEQ ID NO: 2242) | 23 | downstream |
| CEP290-1436 | − | AACUGGAUGGGUAAUAAAGCAA (SEQ ID NO: 2243) | 22 | downstream |
| CEP290-1437 | − | ACUGGAUGGGUAAUAAAGCAA (SEQ ID NO: 2244) | 21 | downstream |
| CEP290-1438 | + | AUAGAAAUUCACUGAGCAAAACAA (SEQ ID NO: 2245) | 24 | downstream |
| CEP290-1439 | + | AGAAAUUCACUGAGCAAAACAA (SEQ ID NO: 2246) | 22 | downstream |
| CEP290-1440 | + | AAAUUCACUGAGCAAAACAA (SEQ ID NO: 808) | 20 | downstream |
| CEP290-1441 | + | AAUUCACUGAGCAAAACAA (SEQ ID NO: 2248) | 19 | downstream |
| CEP290-1442 | + | AUUCACUGAGCAAAACAA (SEQ ID NO: 2249) | 18 | downstream |
| CEP290-1443 | + | AGGAUGUAAGACUGGAGAUAGAGA (SEQ ID NO: 2250) | 24 | downstream |

TABLE 9E-continued

| gRNA Name | DNA Strand | Targeting Domain | Target Site Length | Position relative to mutation |
|---|---|---|---|---|
| CEP290-1444 | + | AUGUAAGACUGGAGAUAGAGA (SEQ ID NO: 2251) | 21 | downstream |
| CEP290-1445 | − | AAAUUUGAUAGUAGAAGAAAA (SEQ ID NO: 2252) | 21 | downstream |
| CEP290-1446 | − | AAUUUGAUAGUAGAAGAAAA (SEQ ID NO: 2253) | 20 | downstream |
| CEP290-1447 | − | AUUUGAUAGUAGAAGAAAA (SEQ ID NO: 2254) | 19 | downstream |
| CEP290-1448 | + | AAAAUAAAACUAAGACACUGCCAA (SEQ ID NO: 1036) | 24 | downstream |
| CEP290-1449 | + | AAAUAAAACUAAGACACUGCCAA (SEQ ID NO: 1037) | 23 | downstream |
| CEP290-1450 | + | AAUAAAACUAAGACACUGCCAA (SEQ ID NO: 1038) | 22 | downstream |
| CEP290-1451 | + | AUAAAACUAAGACACUGCCAA (SEQ ID NO: 1039) | 21 | downstream |
| CEP290-1452 | + | AAAACUAAGACACUGCCAA (SEQ ID NO: 1040) | 19 | downstream |
| CEP290-1453 | + | AAACUAAGACACUGCCAA (SEQ ID NO: 1041) | 18 | downstream |
| CEP290-1454 | − | AAUAAAGCAAAAGAAAAC (SEQ ID NO: 2261) | 19 | downstream |
| CEP290-1455 | − | AUAAAGCAAAAGAAAAC (SEQ ID NO: 2262) | 18 | downstream |
| CEP290-1456 | − | AUUCUUUUUUGUUGUUUUUUUU (SEQ ID NO: 2263) | 24 | downstream |
| CEP290-1457 | + | ACUCCAGCCUGGGCAACACA (SEQ ID NO: 2264) | 20 | downstream |
| CEP290-1458 | − | CUUACCUCAUGUCAUCUAGAGC (SEQ ID NO: 2265) | 22 | downstream |
| CEP290-1459 | − | CCUCAUGUCAUCUAGAGC (SEQ ID NO: 2266) | 18 | downstream |
| CEP290-1460 | + | CAGUUUUUAAGGCGGGGAGUCAC (SEQ ID NO: 2267) | 23 | downstream |
| CEP290-1461 | − | CACAGAGUUCAAGCUAAUAC (SEQ ID NO: 845) | 20 | downstream |
| CEP290-1462 | − | CAGAGUUCAAGCUAAUAC (SEQ ID NO: 2269) | 18 | downstream |
| CEP290-1463 | + | CUUGAACUCUGUGCCAAAC (SEQ ID NO: 2270) | 19 | downstream |
| CEP290-1464 | − | CAUGUGGUGUCAAAUAUGGUGCU (SEQ ID NO: 2271) | 23 | downstream |
| CEP290-1465 | − | CAUGUGGUGUCAAAUAUGGUGCUU (SEQ ID NO: 2272) | 24 | downstream |
| CEP290-1466 | + | CUCUAGAUGACAUGAGGUAAGU (SEQ ID NO: 2273) | 22 | downstream |
| CEP290-1467 | + | CUAGAUGACAUGAGGUAAGU (SEQ ID NO: 671) | 20 | downstream |
| CEP290-1468 | − | CUAAUACAUGAGAGUGAUUAGUGG (SEQ ID NO: 2275) | 24 | downstream |

TABLE 9E-continued

| gRNA Name | DNA Strand | Targeting Domain | Target Site Length | Position relative to mutation |
|---|---|---|---|---|
| CEP290-1469 | − | CAUGAGAGUGAUUAGUGG (SEQ ID NO: 2276) | 18 | downstream |
| CEP290-509 | + | CACUGCCAAUAGGGAUAGGU (SEQ ID NO: 613) | 20 | downstream |
| CEP290-511 | + | CUGCCAAUAGGGAUAGGU (SEQ ID NO: 1046) | 18 | downstream |
| CEP290-1470 | + | CCAAACAGGAGAUACUCAACACA (SEQ ID NO: 2278) | 23 | downstream |
| CEP290-1471 | + | CAAACAGGAGAUACUCAACACA (SEQ ID NO: 2279) | 22 | downstream |
| CEP290-1472 | + | CAGGAGAUACUCAACACA (SEQ ID NO: 2280) | 18 | downstream |
| CEP290-1473 | + | CACGUACAAAAGAACAUACAU (SEQ ID NO: 2281) | 21 | downstream |
| CEP290-1474 | + | CGUACAAAAGAACAUACAU (SEQ ID NO: 2282) | 19 | downstream |
| CEP290-1475 | + | CAGUAAGGAGGAUGUAAGAC (SEQ ID NO: 676) | 20 | downstream |
| CEP290-1476 | + | CUUUUGACAGUUUUUAAGG (SEQ ID NO: 2284) | 19 | downstream |
| CEP290-1477 | − | CGUGCUCUUUUCUAUAUAU (SEQ ID NO: 2285) | 19 | downstream |
| CEP290-1478 | + | CACUGAGCAAAACAACUGG (SEQ ID NO: 2286) | 19 | downstream |
| CEP290-1479 | + | CCUGAACAAGUUUUGAAACAGGAA (SEQ ID NO: 2287) | 24 | downstream |
| CEP290-1480 | + | CUGAACAAGUUUUGAAACAGGAA (SEQ ID NO: 2288) | 23 | downstream |
| CEP290-1481 | + | CAAGUUUUGAAACAGGAA (SEQ ID NO: 2289) | 18 | downstream |
| CEP290-1482 | + | CCUGAACAAGUUUUGAAA (SEQ ID NO: 2290) | 18 | downstream |
| CEP290-1483 | + | CACUGAGCAAAACAACUGGAA (SEQ ID NO: 2291) | 21 | downstream |
| CEP290-1484 | + | CUGAGCAAAACAACUGGAA (SEQ ID NO: 2292) | 19 | downstream |
| CEP290-1485 | − | CGUGCUCUUUUCUAUAUA (SEQ ID NO: 2293) | 18 | downstream |
| CEP290-1486 | + | CUAUUCCAUUCUUCACAC (SEQ ID NO: 2294) | 18 | downstream |
| CEP290-1487 | − | CUUAGGAAAUUAUUGUUGCUUU (SEQ ID NO: 2295) | 22 | downstream |
| CEP290-1488 | − | CUUUUUGAGAGGUAAAGGUUC (SEQ ID NO: 2296) | 21 | downstream |
| CEP290-1489 | + | CACUGAGCAAAACAACUGGAAGA (SEQ ID NO: 2297) | 23 | downstream |
| CEP290-1490 | + | CUGAGCAAAACAACUGGAAGA (SEQ ID NO: 2298) | 21 | downstream |
| CEP290-1491 | + | CAUAAGAAAGAACACUGUGGU (SEQ ID NO: 2299) | 21 | downstream |

TABLE 9E-continued

| gRNA Name | DNA Strand | Targeting Domain | Target Site Length | Position relative to mutation |
|---|---|---|---|---|
| CEP290-1492 | − | CUUGAAAUUUGAUAGUAG (SEQ ID NO: 2300) | 18 | downstream |
| CEP290-1493 | + | CCAUUAAAAAAAGUAUGCUU (SEQ ID NO: 857) | 20 | downstream |
| CEP290-1494 | + | CAUUAAAAAAAGUAUGCUU (SEQ ID NO: 2302) | 19 | downstream |
| CEP290-1495 | + | CAAAAGACUUAUAUUCCAUU (SEQ ID NO: 842) | 20 | downstream |
| CEP290-1496 | − | CAGAUUUCAUGUGUGAAGA (SEQ ID NO: 2304) | 19 | downstream |
| CEP290-1497 | − | CUGGAUGGGUAAUAAAGCAA (SEQ ID NO: 2305) | 20 | downstream |
| CEP290-1498 | − | CUUAAGCAUACUUUUUUUUA (SEQ ID NO: 2306) | 19 | downstream |
| CEP290-1499 | − | CUUUUUUUGUUGUUUUUUUUU (SEQ ID NO: 2307) | 21 | downstream |
| CEP290-1500 | + | CUGCACUCCAGCCUGGGCAACACA (SEQ ID NO: 2308) | 24 | downstream |
| CEP290-1501 | + | CACUCCAGCCUGGGCAACACA (SEQ ID NO: 2309) | 21 | downstream |
| CEP290-1502 | + | CUCCAGCCUGGGCAACACA (SEQ ID NO: 2310) | 19 | downstream |
| CEP290-1503 | + | GUUUUUAAGGCGGGGAGUCAC (SEQ ID NO: 2311) | 21 | downstream |
| CEP290-230 | − | GGCACAGAGUUCAAGCUAAUAC (SEQ ID NO: 2312) | 22 | downstream |
| CEP290-1504 | − | GCACAGAGUUCAAGCUAAUAC (SEQ ID NO: 2313) | 21 | downstream |
| CEP290-1505 | + | GCUUGAACUCUGUGCCAAAC (SEQ ID NO: 461) | 20 | downstream |
| CEP290-139 | − | GCAUGUGGUGUCAAAUAUGGUGCU (SEQ ID NO: 2314) | 24 | downstream |
| CEP290-1506 | − | GUGGUGUCAAAUAUGGUGCU (SEQ ID NO: 782) | 20 | downstream |
| CEP290-1507 | − | GGUGUCAAAUAUGGUGCU (SEQ ID NO: 2316) | 18 | downstream |
| CEP290-1508 | − | GUGGUGUCAAAUAUGGUGCUU (SEQ ID NO: 2317) | 21 | downstream |
| CEP290-1509 | − | GGUGUCAAAUAUGGUGCUU (SEQ ID NO: 2318) | 19 | downstream |
| CEP290-1510 | − | GUGUCAAAUAUGGUGCUU (SEQ ID NO: 2319) | 18 | downstream |
| CEP290-1511 | + | GCUCUAGAUGACAUGAGGUAAGU (SEQ ID NO: 2320) | 23 | downstream |
| CEP290-11 | + | GACACUGCCAAUAGGGAUAGGU (SEQ ID NO: 1047) | 22 | downstream |
| CEP290-1512 | − | GGUUCAUGAGACUAGAGGUC (SEQ ID NO: 2322) | 20 | downstream |
| CEP290-1513 | − | GUUCAUGAGACUAGAGGUC (SEQ ID NO: 2323) | 19 | downstream |

TABLE 9E-continued

| gRNA Name | DNA Strand | Targeting Domain | Target Site Length | Position relative to mutation |
|---|---|---|---|---|
| CEP290-1514 | + | GCCAAACAGGAGAUACUCAACACA (SEQ ID NO: 2324) | 24 | downstream |
| CEP290-1515 | + | GAGCACGUACAAAAGAACAUACAU (SEQ ID NO: 2325) | 24 | downstream |
| CEP290-1516 | + | GCACGUACAAAAGAACAUACAU (SEQ ID NO: 2326) | 22 | downstream |
| CEP290-1517 | + | GUACAAAAGAACAUACAU (SEQ ID NO: 2327) | 18 | downstream |
| CEP290-1518 | + | GUGGCAGUAAGGAGGAUGUAAGAC (SEQ ID NO: 2328) | 24 | downstream |
| CEP290-1519 | + | GGCAGUAAGGAGGAUGUAAGAC (SEQ ID NO: 2329) | 22 | downstream |
| CEP290-1520 | + | GCAGUAAGGAGGAUGUAAGAC (SEQ ID NO: 2330) | 21 | downstream |
| CEP290-1521 | + | GUAAGGAGGAUGUAAGAC (SEQ ID NO: 2331) | 18 | downstream |
| CEP290-1522 | + | GGUAGCUUUUGACAGUUUUUAAGG (SEQ ID NO: 2332) | 24 | downstream |
| CEP290-1523 | + | GUAGCUUUUGACAGUUUUUAAGG (SEQ ID NO: 2333) | 23 | downstream |
| CEP290-1524 | + | GCUUUUGACAGUUUUUAAGG (SEQ ID NO: 482) | 20 | downstream |
| CEP290-1525 | − | GUACGUGCUCUUUUCUAUAUAU (SEQ ID NO: 2334) | 22 | downstream |
| CEP290-1526 | − | GUGCUCUUUUCUAUAUAU (SEQ ID NO: 2335) | 18 | downstream |
| CEP290-1527 | + | GAACAAGUUUUGAAACAGGAA (SEQ ID NO: 2336) | 21 | downstream |
| CEP290-1528 | + | GUAAUGCCUGAACAAGUUUUGAAA (SEQ ID NO: 2337) | 24 | downstream |
| CEP290-1529 | + | GCCUGAACAAGUUUUGAAA (SEQ ID NO: 2338) | 19 | downstream |
| CEP290-1530 | + | GGUAAUGCCUGAACAAGUU (SEQ ID NO: 2339) | 19 | downstream |
| CEP290-1531 | + | GUAAUGCCUGAACAAGUU (SEQ ID NO: 2340) | 18 | downstream |
| CEP290-1532 | − | GUACGUGCUCUUUUCUAUAUA (SEQ ID NO: 2341) | 21 | downstream |
| CEP290-1533 | + | GAGAGAAAUGGUUCCCUAUAUA (SEQ ID NO: 2342) | 22 | downstream |
| CEP290-1534 | + | GAGAAAUGGUUCCCUAUAUA (SEQ ID NO: 771) | 20 | downstream |
| CEP290-1535 | + | GAAAUGGUUCCCUAUAUA (SEQ ID NO: 2344) | 18 | downstream |
| CEP290-1536 | − | GCUUAGGAAAUUAUUGUUGCUUU (SEQ ID NO: 2345) | 23 | downstream |
| CEP290-1537 | − | GGAAAUUAUUGUUGCUUU (SEQ ID NO: 2346) | 18 | downstream |
| CEP290-1538 | − | GCUUUUUGAGAGGUAAAGGUUC (SEQ ID NO: 2347) | 22 | downstream |

TABLE 9E-continued

| gRNA Name | DNA Strand | Targeting Domain | Target Site Length | Position relative to mutation |
|---|---|---|---|---|
| CEP290-1539 | + | GAGCAAACAACUGGAAGA (SEQ ID NO: 2348) | 19 | downstream |
| CEP290-1540 | − | GUGUGAAGAAUGGAAUAGAUAAU (SEQ ID NO: 2349) | 23 | downstream |
| CEP290-1541 | − | GUGAAGAAUGGAAUAGAUAAU (SEQ ID NO: 2350) | 21 | downstream |
| CEP290-1542 | − | GAAGAAUGGAAUAGAUAAU (SEQ ID NO: 2351) | 19 | downstream |
| CEP290-1543 | + | GUAAGGAGGAUGUAAGACUGGAGA (SEQ ID NO: 2352) | 24 | downstream |
| CEP290-1544 | + | GGAGGAUGUAAGACUGGAGA (SEQ ID NO: 779) | 20 | downstream |
| CEP290-1545 | + | GAGGAUGUAAGACUGGAGA (SEQ ID NO: 2354) | 19 | downstream |
| CEP290-1546 | − | GAAAAACUUGAAAUUUGAUAGUAG (SEQ ID NO: 2355) | 24 | downstream |
| CEP290-1547 | − | GUGUUUACAUAUCUGUCUUCCUUA (SEQ ID NO: 2356) | 24 | downstream |
| CEP290-1548 | − | GUUUACAUAUCUGUCUUCCUUA (SEQ ID NO: 2357) | 22 | downstream |
| CEP290-1549 | + | GUUCCAUUAAAAAAAGUAUGCUU (SEQ ID NO: 2358) | 23 | downstream |
| CEP290-1550 | − | GGAAUAUAAGUCUUUUGAUAU (SEQ ID NO: 2359) | 21 | downstream |
| CEP290-1551 | − | GAAUAUAAGUCUUUUGAUAU (SEQ ID NO: 770) | 20 | downstream |
| CEP290-1552 | − | GUGUGAAGAAUGGAAUAGAUAAUA (SEQ ID NO: 2361) | 24 | downstream |
| CEP290-1553 | − | GUGAAGAAUGGAAUAGAUAAUA (SEQ ID NO: 2362) | 22 | downstream |
| CEP290-1554 | − | GAAGAAUGGAAUAGAUAAUA (SEQ ID NO: 467) | 20 | downstream |
| CEP290-1555 | − | GGAUGGGUAAUAAAGCAA (SEQ ID NO: 2363) | 18 | downstream |
| CEP290-1556 | + | GAAAUUCACUGAGCAAAACAA (SEQ ID NO: 2364) | 21 | downstream |
| CEP290-1557 | + | GGAUGUAAGACUGGAGAUAGAGA (SEQ ID NO: 2365) | 23 | downstream |
| CEP290-1558 | + | GAUGUAAGACUGGAGAUAGAGA (SEQ ID NO: 2366) | 22 | downstream |
| CEP290-1559 | + | GUAAGACUGGAGAUAGAGA (SEQ ID NO: 2367) | 19 | downstream |
| CEP290-1560 | − | GAAAUUUGAUAGUAGAAGAAAA (SEQ ID NO: 2368) | 22 | downstream |
| CEP290-1561 | − | GGGUAAUAAAGCAAAGAAAAAC (SEQ ID NO: 2369) | 23 | downstream |
| CEP290-1562 | − | GGUAAUAAAGCAAAGAAAAAC (SEQ ID NO: 2370) | 22 | downstream |
| CEP290-1563 | − | GUAAUAAAGCAAAGAAAAAC (SEQ ID NO: 2371) | 21 | downstream |

TABLE 9E-continued

| gRNA Name | DNA Strand | Targeting Domain | Target Site Length | Position relative to mutation |
|---|---|---|---|---|
| CEP290-1564 | + | GCACUCCAGCCUGGGCAACACA (SEQ ID NO: 2372) | 22 | downstream |
| CEP290-1565 | − | UACUUACCUCAUGUCAUCUAGAGC (SEQ ID NO: 2373) | 24 | downstream |
| CEP290-1566 | − | UUACCUCAUGUCAUCUAGAGC (SEQ ID NO: 2374) | 21 | downstream |
| CEP290-1567 | − | UACCUCAUGUCAUCUAGAGC (SEQ ID NO: 876) | 20 | downstream |
| CEP290-1568 | + | UUUUUAAGGCGGGGAGUCAC (SEQ ID NO: 909) | 20 | downstream |
| CEP290-1569 | + | UUUUAAGGCGGGGAGUCAC (SEQ ID NO: 2377) | 19 | downstream |
| CEP290-1570 | + | UUUAAGGCGGGGAGUCAC (SEQ ID NO: 2378) | 18 | downstream |
| CEP290-1571 | − | UUGGCACAGAGUUCAAGCUAAUAC (SEQ ID NO: 2379) | 24 | downstream |
| CEP290-1572 | − | UGGCACAGAGUUCAAGCUAAUAC (SEQ ID NO: 2380) | 23 | downstream |
| CEP290-1573 | + | UUAGCUUGAACUCUGUGCCAAAC (SEQ ID NO: 2381) | 23 | downstream |
| CEP290-1574 | + | UAGCUUGAACUCUGUGCCAAAC (SEQ ID NO: 2382) | 22 | downstream |
| CEP290-1575 | + | UUGAACUCUGUGCCAAAC (SEQ ID NO: 2383) | 18 | downstream |
| CEP290-1576 | − | UGUGGUGUCAAAUAUGGUGCU (SEQ ID NO: 2384) | 21 | downstream |
| CEP290-1577 | − | UGGUGUCAAAUAUGGUGCU (SEQ ID NO: 2385) | 19 | downstream |
| CEP290-1578 | − | UGUGGUGUCAAAUAUGGUGCUU (SEQ ID NO: 2386) | 22 | downstream |
| CEP290-1579 | − | UGGUGUCAAAUAUGGUGCUU (SEQ ID NO: 625) | 20 | downstream |
| CEP290-1580 | + | UGCUCUAGAUGACAUGAGGUAAGU (SEQ ID NO: 2388) | 24 | downstream |
| CEP290-1581 | + | UCUAGAUGACAUGAGGUAAGU (SEQ ID NO: 2389) | 21 | downstream |
| CEP290-1582 | + | UAGAUGACAUGAGGUAAGU (SEQ ID NO: 2390) | 19 | downstream |
| CEP290-1583 | − | UAAUACAUGAGAGUGAUUAGUGG (SEQ ID NO: 2391) | 23 | downstream |
| CEP290-1584 | − | UACAUGAGAGUGAUUAGUGG (SEQ ID NO: 628) | 20 | downstream |
| CEP290-1585 | − | UAAAGGUUCAUGAGACUAGAGGUC (SEQ ID NO: 2392) | 24 | downstream |
| CEP290-1586 | − | UUCAUGAGACUAGAGGUC (SEQ ID NO: 2393) | 18 | downstream |
| CEP290-1587 | + | UGGCAGUAAGGAGGAUGUAAGAC (SEQ ID NO: 2394) | 23 | downstream |
| CEP290-1588 | + | UAGCUUUUGACAGUUUUUAAGG (SEQ ID NO: 2395) | 22 | downstream |

TABLE 9E-continued

| gRNA Name | DNA Strand | Targeting Domain | Target Site Length | Position relative to mutation |
|---|---|---|---|---|
| CEP290-1589 | + | UUUUGACAGUUUUUAAGG (SEQ ID NO: 2396) | 18 | downstream |
| CEP290-1590 | − | UUGUACGUGCUCUUUUCUAUAUAU (SEQ ID NO: 2397) | 24 | downstream |
| CEP290-1591 | − | UGUACGUGCUCUUUUCUAUAUAU (SEQ ID NO: 2398) | 23 | downstream |
| CEP290-1592 | − | UACGUGCUCUUUUCUAUAUAU (SEQ ID NO: 2399) | 21 | downstream |
| CEP290-1593 | + | UUCACUGAGCAAAACAACUGG (SEQ ID NO: 2400) | 21 | downstream |
| CEP290-1594 | + | UCACUGAGCAAAACAACUGG (SEQ ID NO: 883) | 20 | downstream |
| CEP290-1595 | + | UGAACAAGUUUUGAAACAGGAA (SEQ ID NO: 2402) | 22 | downstream |
| CEP290-1596 | + | UAAUGCCUGAACAAGUUUUGAAA (SEQ ID NO: 2403) | 23 | downstream |
| CEP290-1597 | + | UGCCUGAACAAGUUUUGAAA (SEQ ID NO: 897) | 20 | downstream |
| CEP290-1598 | + | UUCACUGAGCAAAACAACUGGAA (SEQ ID NO: 2405) | 23 | downstream |
| CEP290-1599 | + | UCACUGAGCAAAACAACUGGAA (SEQ ID NO: 2406) | 22 | downstream |
| CEP290-1600 | + | UGAGCAAAACAACUGGAA (SEQ ID NO: 2407) | 18 | downstream |
| CEP290-1601 | − | UUUGUACGUGCUCUUUUCUAUAUA (SEQ ID NO: 2408) | 24 | downstream |
| CEP290-1602 | − | UUGUACGUGCUCUUUUCUAUAUA (SEQ ID NO: 2409) | 23 | downstream |
| CEP290-1603 | − | UGUACGUGCUCUUUUCUAUAUA (SEQ ID NO: 2410) | 22 | downstream |
| CEP290-1604 | − | UACGUGCUCUUUUCUAUAUA (SEQ ID NO: 877) | 20 | downstream |
| CEP290-1605 | + | UAUUAUCUAUUCCAUUCUUCACAC (SEQ ID NO: 2412) | 24 | downstream |
| CEP290-1606 | + | UUAUCUAUUCCAUUCUUCACAC (SEQ ID NO: 2413) | 22 | downstream |
| CEP290-1607 | + | UAUCUAUUCCAUUCUUCACAC (SEQ ID NO: 2414) | 21 | downstream |
| CEP290-1608 | + | UCUAUUCCAUUCUUCACAC (SEQ ID NO: 2415) | 19 | downstream |
| CEP290-1609 | − | UGCUUAGGAAAUUAUUGUUGCUUU (SEQ ID NO: 2416) | 24 | downstream |
| CEP290-1610 | − | UUAGGAAAUUAUUGUUGCUUU (SEQ ID NO: 2417) | 21 | downstream |
| CEP290-1611 | − | UAGGAAAUUAUUGUUGCUUU (SEQ ID NO: 2418) | 20 | downstream |
| CEP290-1612 | − | UUGCUUUUGAGAGGUAAAGGUUC (SEQ ID NO: 2419) | 24 | downstream |
| CEP290-1613 | − | UGCUUUUGAGAGGUAAAGGUUC (SEQ ID NO: 2420) | 23 | downstream |

TABLE 9E-continued

| gRNA Name | DNA Strand | Targeting Domain | Target Site Length | Position relative to mutation |
|---|---|---|---|---|
| CEP290-1614 | − | UUUUUGAGAGGUAAAGGUUC (SEQ ID NO: 2421) | 20 | downstream |
| CEP290-1615 | − | UUUUGAGAGGUAAAGGUUC (SEQ ID NO: 2422) | 19 | downstream |
| CEP290-1616 | − | UUUGAGAGGUAAAGGUUC (SEQ ID NO: 2423) | 18 | downstream |
| CEP290-1617 | + | UCACUGAGCAAAACAACUGGAAGA (SEQ ID NO: 2424) | 24 | downstream |
| CEP290-1618 | + | UGAGCAAAACAACUGGAAGA (SEQ ID NO: 894) | 20 | downstream |
| CEP290-1619 | + | UACAUAAGAAAGAACACUGUGGU (SEQ ID NO: 2426) | 23 | downstream |
| CEP290-1620 | + | UAAGAAAGAACACUGUGGU (SEQ ID NO: 2427) | 19 | downstream |
| CEP290-1621 | − | UGUGUGAAGAAUGGAAUAGAUAAU (SEQ ID NO: 2428) | 24 | downstream |
| CEP290-1622 | − | UGUGAAGAAUGGAAUAGAUAAU (SEQ ID NO: 2429) | 22 | downstream |
| CEP290-1623 | − | UGAAGAAUGGAAUAGAUAAU (SEQ ID NO: 2430) | 20 | downstream |
| CEP290-1624 | + | UAAGGAGGAUGUAAGACUGGAGA (SEQ ID NO: 2431) | 23 | downstream |
| CEP290-1625 | − | UGUUUACAUAUCUGUCUUCCUUA (SEQ ID NO: 2432) | 23 | downstream |
| CEP290-1626 | − | UUUACAUAUCUGUCUUCCUUA (SEQ ID NO: 2433) | 21 | downstream |
| CEP290-1627 | − | UUACAUAUCUGUCUUCCUUA (SEQ ID NO: 901) | 20 | downstream |
| CEP290-1628 | − | UACAUAUCUGUCUUCCUUA (SEQ ID NO: 2435) | 19 | downstream |
| CEP290-1629 | + | UGUUCCAUUAAAAAAAGUAUGCUU (SEQ ID NO: 2436) | 24 | downstream |
| CEP290-1630 | + | UUCCAUUAAAAAAAGUAUGCUU (SEQ ID NO: 2437) | 22 | downstream |
| CEP290-1631 | + | UCCAUUAAAAAAAGUAUGCUU (SEQ ID NO: 2438) | 21 | downstream |
| CEP290-1632 | + | UAUCAAAAGACUUAUAUUCCAUU (SEQ ID NO: 2439) | 23 | downstream |
| CEP290-1633 | + | UCAAAAGACUUAUAUUCCAUU (SEQ ID NO: 2440) | 21 | downstream |
| CEP290-1634 | − | UCAGAUUUCAUGUGUGAAGA (SEQ ID NO: 2441) | 20 | downstream |
| CEP290-1635 | − | UGGAAUAUAAGUCUUUUGAUAU (SEQ ID NO: 2442) | 22 | downstream |
| CEP290-1636 | − | UGUGAAGAAUGGAAUAGAUAAUA (SEQ ID NO: 2443) | 23 | downstream |
| CEP290-1637 | − | UGAAGAAUGGAAUAGAUAAUA (SEQ ID NO: 2444) | 21 | downstream |
| CEP290-1638 | − | UGGAUGGGUAAUAAAGCAA (SEQ ID NO: 2445) | 19 | downstream |

TABLE 9E-continued

| gRNA Name | DNA Strand | Targeting Domain | Target Site Length | Position relative to mutation |
|---|---|---|---|---|
| CEP290-1639 | + | UAGAAAUUCACUGAGCAAAACAA (SEQ ID NO: 2446) | 23 | downstream |
| CEP290-1640 | + | UGUAAGACUGGAGAUAGAGA (SEQ ID NO: 898) | 20 | downstream |
| CEP290-1641 | + | UAAGACUGGAGAUAGAGA (SEQ ID NO: 2448) | 18 | downstream |
| CEP290-1642 | − | UUGAAAUUUGAUAGUAGAAGAAAA (SEQ ID NO: 2449) | 24 | downstream |
| CEP290-1643 | − | UGAAAUUUGAUAGUAGAAGAAAA (SEQ ID NO: 2450) | 23 | downstream |
| CEP290-1644 | − | UUUGAUAGUAGAAGAAAA (SEQ ID NO: 2451) | 18 | downstream |
| CEP290-1645 | + | UAAAACUAAGACACUGCCAA (SEQ ID NO: 871) | 20 | downstream |
| CEP290-1646 | − | UUUUUCUUAAGCAUACUUUUUUUA (SEQ ID NO: 2453) | 24 | downstream |
| CEP290-1647 | − | UUUUCUUAAGCAUACUUUUUUUA (SEQ ID NO: 2454) | 23 | downstream |
| CEP290-1648 | − | UUUCUUAAGCAUACUUUUUUUA (SEQ ID NO: 2455) | 22 | downstream |
| CEP290-1649 | − | UUCUUAAGCAUACUUUUUUUA (SEQ ID NO: 2456) | 21 | downstream |
| CEP290-1650 | − | UCUUAAGCAUACUUUUUUUA (SEQ ID NO: 891) | 20 | downstream |
| CEP290-1651 | − | UUAAGCAUACUUUUUUUA (SEQ ID NO: 2458) | 18 | downstream |
| CEP290-1652 | − | UGGGUAAUAAAGCAAAAGAAAAAC (SEQ ID NO: 2459) | 24 | downstream |
| CEP290-1653 | − | UAAUAAAGCAAAAGAAAAAC (SEQ ID NO: 2460) | 20 | downstream |
| CEP290-1654 | − | UUCUUUUUUGUUGUUUUUUUU (SEQ ID NO: 2461) | 23 | downstream |
| CEP290-1655 | − | UCUUUUUUGUUGUUUUUUUU (SEQ ID NO: 2462) | 22 | downstream |
| CEP290-1656 | − | UUUUUUGUUGUUUUUUUU (SEQ ID NO: 2463) | 20 | downstream |
| CEP290-1657 | − | UUUUUUGUUGUUUUUUUU (SEQ ID NO: 2464) | 19 | downstream |
| CEP290-1658 | − | UUUUUGUUGUUUUUUUU (SEQ ID NO: 2465) | 18 | downstream |
| CEP290-1659 | + | UGCACUCCAGCCUGGGCAACACA (SEQ ID NO: 2466) | 23 | downstream |
| CEP290-1660 | + | UCCAGCCUGGGCAACACA (SEQ ID NO: 2467) | 18 | downstream |
| CEP290-1661 | + | AUUUUCGUGACCUCUAGUCUC (SEQ ID NO: 2468) | 21 | downstream |
| CEP290-1662 | + | ACUAAUCACUCUCAUGUAUUAGC (SEQ ID NO: 2469) | 23 | downstream |
| CEP290-1663 | + | AAUCACUCUCAUGUAUUAGC (SEQ ID NO: 814) | 20 | downstream |

TABLE 9E-continued

| gRNA Name | DNA Strand | Targeting Domain | Target Site Length | Position relative to mutation |
|---|---|---|---|---|
| CEP290-1664 | + | AUCACUCUCAUGUAUUAGC (SEQ ID NO: 2471) | 19 | downstream |
| CEP290-1665 | + | AGAUGACAUGAGGUAAGUA (SEQ ID NO: 2472) | 19 | downstream |
| CEP290-1666 | − | ACCUCAUGUCAUCUAGAGCAAGAG (SEQ ID NO: 2473) | 24 | downstream |
| CEP290-1667 | − | AUGUCAUCUAGAGCAAGAG (SEQ ID NO: 2474) | 19 | downstream |
| CEP290-1668 | − | AAUACAUGAGAGUGAUUAGUGGUG (SEQ ID NO: 2475) | 24 | downstream |
| CEP290-1669 | − | AUACAUGAGAGUGAUUAGUGGUG (SEQ ID NO: 2476) | 23 | downstream |
| CEP290-1670 | − | ACAUGAGAGUGAUUAGUGGUG (SEQ ID NO: 2477) | 21 | downstream |
| CEP290-1671 | − | AUGAGAGUGAUUAGUGGUG (SEQ ID NO: 2478) | 19 | downstream |
| CEP290-1672 | − | ACGUGCUCUUUUCUAUAUAUA (SEQ ID NO: 2479) | 21 | downstream |
| CEP290-1673 | + | ACAAAACCUAUGUAUAAGAUG (SEQ ID NO: 2480) | 21 | downstream |
| CEP290-1674 | + | AAAACCUAUGUAUAAGAUG (SEQ ID NO: 2481) | 19 | downstream |
| CEP290-1675 | + | AAACCUAUGUAUAAGAUG (SEQ ID NO: 2482) | 18 | downstream |
| CEP290-1676 | + | AUAUAUAGAAAAGAGCACGUACAA (SEQ ID NO: 2483) | 24 | downstream |
| CEP290-1677 | + | AUAUAGAAAAGAGCACGUACAA (SEQ ID NO: 2484) | 22 | downstream |
| CEP290-1678 | + | AUAGAAAAGAGCACGUACAA (SEQ ID NO: 832) | 20 | downstream |
| CEP290-1679 | + | AGAAAAGAGCACGUACAA (SEQ ID NO: 2486) | 18 | downstream |
| CEP290-1680 | + | AGAAAUGGUUCCCUAUAUAUAGAA (SEQ ID NO: 2487) | 24 | downstream |
| CEP290-1681 | + | AAAUGGUUCCCUAUAUAUAGAA (SEQ ID NO: 2488) | 22 | downstream |
| CEP290-1682 | + | AAUGGUUCCCUAUAUAUAGAA (SEQ ID NO: 2489) | 21 | downstream |
| CEP290-1683 | + | AUGGUUCCCUAUAUAUAGAA (SEQ ID NO: 839) | 20 | downstream |
| CEP290-1684 | − | AUGGAAUAUAAGUCUUUUGAUAUA (SEQ ID NO: 2491) | 24 | downstream |
| CEP290-1685 | − | AAUAUAAGUCUUUUGAUAUA (SEQ ID NO: 687) | 20 | downstream |
| CEP290-1686 | − | AUAUAAGUCUUUUGAUAUA (SEQ ID NO: 2493) | 19 | downstream |
| CEP290-1687 | + | ACGUACAAAAGAACAUACAUAAGA (SEQ ID NO: 2494) | 24 | downstream |
| CEP290-1688 | + | ACAAAAGAACAUACAUAAGA (SEQ ID NO: 816) | 20 | downstream |

TABLE 9E-continued

| gRNA Name | DNA Strand | Targeting Domain | Target Site Length | Position relative to mutation |
|---|---|---|---|---|
| CEP290-1689 | + | AAAAGAACAUACAUAAGA (SEQ ID NO: 2496) | 18 | downstream |
| CEP290-1690 | + | AAGAAAAAAAAGGUAAUGC (SEQ ID NO: 2497) | 19 | downstream |
| CEP290-1691 | + | AGAAAAAAAAGGUAAUGC (SEQ ID NO: 2498) | 18 | downstream |
| CEP290-1692 | + | AAACAGGAAUAGAAAUUCA (SEQ ID NO: 2499) | 19 | downstream |
| CEP290-1693 | + | AACAGGAAUAGAAAUUCA (SEQ ID NO: 2500) | 18 | downstream |
| CEP290-1694 | + | AAGAUCACUCCACUGCACUCCAGC (SEQ ID NO: 2501) | 24 | downstream |
| CEP290-1695 | + | AGAUCACUCCACUGCACUCCAGC (SEQ ID NO: 2502) | 23 | downstream |
| CEP290-1696 | + | AUCACUCCACUGCACUCCAGC (SEQ ID NO: 2503) | 21 | downstream |
| CEP290-1697 | + | ACUCCACUGCACUCCAGC (SEQ ID NO: 2504) | 18 | downstream |
| CEP290-1698 | − | CCCCUACUUACCUCAUGUCAUC (SEQ ID NO: 2505) | 22 | downstream |
| CEP290-1699 | − | CCCUACUUACCUCAUGUCAUC (SEQ ID NO: 2506) | 21 | downstream |
| CEP290-1700 | − | CCUACUUACCUCAUGUCAUC (SEQ ID NO: 747) | 20 | downstream |
| CEP290-1701 | − | CUACUUACCUCAUGUCAUC (SEQ ID NO: 2508) | 19 | downstream |
| CEP290-1702 | + | CUGAUUUCGUGACCUCUAGUCUC (SEQ ID NO: 2509) | 24 | downstream |
| CEP290-1703 | + | CACUAAUCACUCUCAUGUAUUAGC (SEQ ID NO: 2510) | 24 | downstream |
| CEP290-1704 | + | CUAAUCACUCUCAUGUAUUAGC (SEQ ID NO: 2511) | 22 | downstream |
| CEP290-1705 | + | CUCUAGAUGACAUGAGGUAAGUA (SEQ ID NO: 2512) | 23 | downstream |
| CEP290-1706 | + | CUAGAUGACAUGAGGUAAGUA (SEQ ID NO: 2513) | 21 | downstream |
| CEP290-1707 | − | CCUCAUGUCAUCUAGAGCAAGAG (SEQ ID NO: 2514) | 23 | downstream |
| CEP290-1708 | − | CUCAUGUCAUCUAGAGCAAGAG (SEQ ID NO: 2515) | 22 | downstream |
| CEP290-1709 | − | CAUGUCACUAGAGCAAGAG (SEQ ID NO: 855) | 20 | downstream |
| CEP290-1710 | − | CAUGAGAGUGAUUAGUGGUG (SEQ ID NO: 854) | 20 | downstream |
| CEP290-1711 | − | CGUGCUCUUUUCUAUAUAUA (SEQ ID NO: 624) | 20 | downstream |
| CEP290-1712 | + | CAAAACCUAUGUAUAAGAUG (SEQ ID NO: 841) | 20 | downstream |
| CEP290-1713 | + | CGUACAAAAGAACAUACAUAAGA (SEQ ID NO: 2520) | 23 | downstream |

TABLE 9E-continued

| gRNA Name | DNA Strand | Targeting Domain | Target Site Length | Position relative to mutation |
|---|---|---|---|---|
| CEP290-1714 | + | CAAAAGAACAUACAUAAGA (SEQ ID NO: 2521) | 19 | downstream |
| CEP290-1715 | + | CUUAAGAAAAAAAAGGUAAUGC (SEQ ID NO: 2522) | 22 | downstream |
| CEP290-1716 | − | CUUAAGCAUACUUUUUUAA (SEQ ID NO: 690) | 20 | downstream |
| CEP290-1717 | + | CACUCCACUGCACUCCAGC (SEQ ID NO: 2524) | 19 | downstream |
| CEP290-132 | − | GUCCCUACUUACCUCAUGUCAUC (SEQ ID NO: 2525) | 24 | downstream |
| CEP290-1718 | + | GAUUUUCGUGACCUCUAGUCUC (SEQ ID NO: 2526) | 22 | downstream |
| CEP290-1719 | + | GCUCUAGAUGACAUGAGGUAAGUA (SEQ ID NO: 2527) | 24 | downstream |
| CEP290-1720 | + | GAUGACAUGAGGUAAGUA (SEQ ID NO: 2528) | 18 | downstream |
| CEP290-1721 | − | GUACGUGCUCUUUUCUAUAUAUA (SEQ ID NO: 2529) | 23 | downstream |
| CEP290-1722 | − | GUGCUCUUUUCUAUAUAUA (SEQ ID NO: 2530) | 19 | downstream |
| CEP290-1723 | + | GUACAAAACCUAUGUAUAAGAUG (SEQ ID NO: 2531) | 23 | downstream |
| CEP290-1724 | + | GAAAUGGUUCCCUAUAUAUAGAA (SEQ ID NO: 2532) | 23 | downstream |
| CEP290-1725 | + | GGUUCCCUAUAUAUAGAA (SEQ ID NO: 2533) | 18 | downstream |
| CEP290-1726 | − | GGAAUAUAAGUCUUUUGAUAUA (SEQ ID NO: 2534) | 22 | downstream |
| CEP290-1727 | − | GAAUAUAAGUCUUUUGAUAUA (SEQ ID NO: 2535) | 21 | downstream |
| CEP290-1728 | + | GUACAAAAGAACAUACAUAAGA (SEQ ID NO: 2536) | 22 | downstream |
| CEP290-1729 | + | GCUUAAGAAAAAAAAGGUAAUGC (SEQ ID NO: 2537) | 23 | downstream |
| CEP290-1730 | + | GAAACAGGAAUAGAAAUUCA (SEQ ID NO: 769) | 20 | downstream |
| CEP290-1731 | + | GAUCACUCCACUGCACUCCAGC (SEQ ID NO: 2539) | 22 | downstream |
| CEP290-1732 | − | UCCCUACUUACCUCAUGUCAUC (SEQ ID NO: 2540) | 23 | downstream |
| CEP290-1733 | − | UACUUACCUCAUGUCAUC (SEQ ID NO: 2541) | 18 | downstream |
| CEP290-1734 | + | UGAUUUUCGUGACCUCUAGUCUC (SEQ ID NO: 2542) | 23 | downstream |
| CEP290-1735 | + | UUUUCGUGACCUCUAGUCUC (SEQ ID NO: 2543) | 20 | downstream |
| CEP290-1736 | + | UUUCGUGACCUCUAGUCUC (SEQ ID NO: 2544) | 19 | downstream |
| CEP290-1737 | + | UUCGUGACCUCUAGUCUC (SEQ ID NO: 2545) | 18 | downstream |

TABLE 9E-continued

| gRNA Name | DNA Strand | Targeting Domain | Target Site Length | Position relative to mutation |
|---|---|---|---|---|
| CEP290-1738 | + | UAAUCACUCUCAUGUAUUAGC (SEQ ID NO: 2546) | 21 | downstream |
| CEP290-1739 | + | UCACUCUCAUGUAUUAGC (SEQ ID NO: 2547) | 18 | downstream |
| CEP290-1740 | + | UCUAGAUGACAUGAGGUAAGUA (SEQ ID NO: 2548) | 22 | downstream |
| CEP290-1741 | + | UAGAUGACAUGAGGUAAGUA (SEQ ID NO: 680) | 20 | downstream |
| CEP290-1742 | − | UCAUGUCAUCUAGAGCAAGAG (SEQ ID NO: 2550) | 21 | downstream |
| CEP290-1743 | − | UGUCAUCUAGAGCAAGAG (SEQ ID NO: 2551) | 18 | downstream |
| CEP290-1744 | − | UACAUGAGAGUGAUUAGUGGUG (SEQ ID NO: 2552) | 22 | downstream |
| CEP290-1745 | − | UGAGAGUGAUUAGUGGUG (SEQ ID NO: 2553) | 18 | downstream |
| CEP290-1746 | − | UGUACGUGCUCUUUUCUAUAUAUA (SEQ ID NO: 2554) | 24 | downstream |
| CEP290-1747 | − | UACGUGCUCUUUUCUAUAUAUA (SEQ ID NO: 2555) | 22 | downstream |
| CEP290-1748 | − | UGCUCUUUUCUAUAUAUA (SEQ ID NO: 2556) | 18 | downstream |
| CEP290-1749 | + | UGUACAAAACCUAUGUAUAAGAUG (SEQ ID NO: 2557) | 24 | downstream |
| CEP290-1750 | + | UACAAAACCUAUGUAUAAGAUG (SEQ ID NO: 2558) | 22 | downstream |
| CEP290-1751 | + | UAUAUAGAAAAGAGCACGUACAA (SEQ ID NO: 2559) | 23 | downstream |
| CEP290-1752 | + | UAUAGAAAAGAGCACGUACAA (SEQ ID NO: 2560) | 21 | downstream |
| CEP290-1753 | + | UAGAAAAGAGCACGUACAA (SEQ ID NO: 2561) | 19 | downstream |
| CEP290-1754 | + | UGGUUCCCUAUAUAUAGAA (SEQ ID NO: 2562) | 19 | downstream |
| CEP290-1755 | − | UGGAAUAUAAGUCUUUUGAUAUA (SEQ ID NO: 2563) | 23 | downstream |
| CEP290-1756 | − | UAUAAGUCUUUUGAUAUA (SEQ ID NO: 2564) | 18 | downstream |
| CEP290-1757 | + | UACAAAAGAACAUACAUAAGA (SEQ ID NO: 2565) | 21 | downstream |
| CEP290-1758 | + | UGCUUAAGAAAAAAAGGUAAUGC (SEQ ID NO: 2566) | 24 | downstream |
| CEP290-1759 | + | UUAAGAAAAAAAGGUAAUGC (SEQ ID NO: 2567) | 21 | downstream |
| CEP290-1760 | + | UAAGAAAAAAAGGUAAUGC (SEQ ID NO: 872) | 20 | downstream |
| CEP290-1761 | + | UUUUGAAACAGGAAUAGAAAUUCA (SEQ ID NO: 2569) | 24 | downstream |
| CEP290-1762 | + | UUUGAAACAGGAAUAGAAAUUCA (SEQ ID NO: 2570) | 23 | downstream |

TABLE 9E-continued

| gRNA Name | DNA Strand | Targeting Domain | Target Site Length | Position relative to mutation |
|---|---|---|---|---|
| CEP290-1763 | + | UUGAAACAGGAAUAGAAAUUCA (SEQ ID NO: 2571) | 22 | downstream |
| CEP290-1764 | + | UGAAACAGGAAUAGAAAUUCA (SEQ ID NO: 2572) | 21 | downstream |
| CEP290-1765 | − | UUUUCUUAAGCAUACUUUUUUAA (SEQ ID NO: 2573) | 24 | downstream |
| CEP290-1766 | − | UUUCUUAAGCAUACUUUUUUAA (SEQ ID NO: 2574) | 23 | downstream |
| CEP290-1767 | − | UUCUUAAGCAUACUUUUUUAA (SEQ ID NO: 2575) | 22 | downstream |
| CEP290-1768 | − | UCUUAAGCAUACUUUUUUAA (SEQ ID NO: 2576) | 21 | downstream |
| CEP290-1769 | − | UUAAGCAUACUUUUUUAA (SEQ ID NO: 2577) | 19 | downstream |
| CEP290-1770 | − | UAAGCAUACUUUUUUAA (SEQ ID NO: 2578) | 18 | downstream |
| CEP290-1771 | + | UCACUCCACUGCACUCCAGC (SEQ ID NO: 2579) | 20 | downstream |
| CEP290-1772 | + | AGUUUUUAAGGCGGGGAGUCACA (SEQ ID NO: 2580) | 23 | downstream |
| CEP290-1773 | − | AAACUGUCAAAAGCUACCGGUUAC (SEQ ID NO: 2581) | 24 | downstream |
| CEP290-1774 | − | AACUGUCAAAAGCUACCGGUUAC (SEQ ID NO: 2582) | 23 | downstream |
| CEP290-252 | − | ACUGUCAAAAGCUACCGGUUAC (SEQ ID NO: 2583) | 22 | downstream |
| CEP290-1775 | + | AGUUCAUCUCUUGCUCUAGAUGAC (SEQ ID NO: 2584) | 24 | downstream |
| CEP290-1776 | + | AUCUCUUGCUCUAGAUGAC (SEQ ID NO: 2585) | 19 | downstream |
| CEP290-1777 | − | ACGAAAAUCAGAUUUCAUGU (SEQ ID NO: 2586) | 20 | downstream |
| CEP290-1778 | − | AAUACAUGAGAGUGAUUAGUG (SEQ ID NO: 2587) | 21 | downstream |
| CEP290-1779 | − | AUACAUGAGAGUGAUUAGUG (SEQ ID NO: 831) | 20 | downstream |
| CEP290-1780 | − | ACAUGAGAGUGAUUAGUG (SEQ ID NO: 2589) | 18 | downstream |
| CEP290-1781 | + | AUUAGCUUGAACUCUGUGCCAAA (SEQ ID NO: 2590) | 23 | downstream |
| CEP290-1782 | + | AGCUUGAACUCUGUGCCAAA (SEQ ID NO: 824) | 20 | downstream |
| CEP290-1783 | − | AUGUAGAUUGAGGUAGAAUCAAG (SEQ ID NO: 2592) | 23 | downstream |
| CEP290-1784 | − | AGAUUGAGGUAGAAUCAAG (SEQ ID NO: 2593) | 19 | downstream |
| CEP290-1785 | + | AUAAGAUGCAGAACUAGUGUAGA (SEQ ID NO: 2594) | 23 | downstream |
| CEP290-1786 | + | AAGAUGCAGAACUAGUGUAGA (SEQ ID NO: 2595) | 21 | downstream |

TABLE 9E-continued

| gRNA Name | DNA Strand | Targeting Domain | Target Site Length | Position relative to mutation |
|---|---|---|---|---|
| CEP290-1787 | + | AGAUGCAGAACUAGUGUAGA (SEQ ID NO: 821) | 20 | downstream |
| CEP290-1788 | + | AUGCAGAACUAGUGUAGA (SEQ ID NO: 2597) | 18 | downstream |
| CEP290-1789 | – | AUAGAUGUAGAUUGAGGUAGAAUC (SEQ ID NO: 2598) | 24 | downstream |
| CEP290-1790 | – | AGAUGUAGAUUGAGGUAGAAUC (SEQ ID NO: 2599) | 22 | downstream |
| CEP290-1791 | – | AUGUAGAUUGAGGUAGAAUC (SEQ ID NO: 2600) | 20 | downstream |
| CEP290-1792 | + | AGAAUGAUCAUUCUUGUGGCAGUA (SEQ ID NO: 2601) | 24 | downstream |
| CEP290-1793 | + | AAUGAUCAUUCUUGUGGCAGUA (SEQ ID NO: 2602) | 22 | downstream |
| CEP290-1794 | + | AUGAUCAUUCUUGUGGCAGUA (SEQ ID NO: 2603) | 21 | downstream |
| CEP290-1795 | + | AUCAUUCUUGUGGCAGUA (SEQ ID NO: 2604) | 18 | downstream |
| CEP290-1796 | + | AGAAUGAUCAUUCUUGUGGCAGU (SEQ ID NO: 2605) | 23 | downstream |
| CEP290-1797 | + | AAUGAUCAUUCUUGUGGCAGU (SEQ ID NO: 2606) | 21 | downstream |
| CEP290-1798 | + | AUGAUCAUUCUUGUGGCAGU (SEQ ID NO: 837) | 20 | downstream |
| CEP290-1799 | – | AGAGGUAAAGGUUCAUGAGAC (SEQ ID NO: 2608) | 21 | downstream |
| CEP290-1800 | – | AGGUAAAGGUUCAUGAGAC (SEQ ID NO: 2609) | 19 | downstream |
| CEP290-1801 | + | AGCUUUUGACAGUUUUUAAG (SEQ ID NO: 825) | 20 | downstream |
| CEP290-1802 | + | AGCUUUUGACAGUUUUUAAGGC (SEQ ID NO: 2611) | 22 | downstream |
| CEP290-1803 | + | AGAAAUUCACUGAGCAAAACAAC (SEQ ID NO: 2612) | 23 | downstream |
| CEP290-1804 | + | AAAUUCACUGAGCAAAACAAC (SEQ ID NO: 2613) | 21 | downstream |
| CEP290-1805 | + | AAUUCACUGAGCAAAACAAC (SEQ ID NO: 678) | 20 | downstream |
| CEP290-1806 | + | AUUCACUGAGCAAAACAAC (SEQ ID NO: 2615) | 19 | downstream |
| CEP290-1807 | + | AGUAAGGAGGAUGUAAGA (SEQ ID NO: 2616) | 18 | downstream |
| CEP290-1808 | + | AUCAAAGACUUAUAUUCCAUUA (SEQ ID NO: 2617) | 23 | downstream |
| CEP290-1809 | + | AAAAGACUUAUAUUCCAUUA (SEQ ID NO: 685) | 20 | downstream |
| CEP290-1810 | + | AAAGACUUAUAUUCCAUUA (SEQ ID NO: 2619) | 19 | downstream |
| CEP290-1811 | + | AAGACUUAUAUUCCAUUA (SEQ ID NO: 2620) | 18 | downstream |

TABLE 9E-continued

| gRNA Name | DNA Strand | Targeting Domain | Target Site Length | Position relative to mutation |
|---|---|---|---|---|
| CEP290-1812 | − | AGGAAAUUAUUGUUGCUUUUU (SEQ ID NO: 2621) | 21 | downstream |
| CEP290-1813 | − | AAAUUAUUGUUGCUUUUU (SEQ ID NO: 2622) | 18 | downstream |
| CEP290-1814 | − | AAAGAAAACUUGAAAUUUGAUAG (SEQ ID NO: 2623) | 24 | downstream |
| CEP290-1815 | − | AAGAAAACUUGAAAUUUGAUAG (SEQ ID NO: 2624) | 23 | downstream |
| CEP290-1816 | − | AGAAAACUUGAAAUUUGAUAG (SEQ ID NO: 2625) | 22 | downstream |
| CEP290-1817 | − | AAAACUUGAAAUUUGAUAG (SEQ ID NO: 2626) | 20 | downstream |
| CEP290-1818 | − | AAACUUGAAAUUUGAUAG (SEQ ID NO: 2627) | 19 | downstream |
| CEP290-1819 | − | AACUUGAAAUUUGAUAG (SEQ ID NO: 2628) | 18 | downstream |
| CEP290-1820 | − | AAGAAAAAGAAAUAGAUGUAGA (SEQ ID NO: 2629) | 23 | downstream |
| CEP290-1821 | − | AGAAAAAGAAAUAGAUGUAGA (SEQ ID NO: 2630) | 22 | downstream |
| CEP290-1822 | − | AAAAAGAAAUAGAUGUAGA (SEQ ID NO: 2631) | 20 | downstream |
| CEP290-1823 | − | AAAAGAAAUAGAUGUAGA (SEQ ID NO: 2632) | 19 | downstream |
| CEP290-1824 | − | AAAGAAAUAGAUGUAGA (SEQ ID NO: 2633) | 18 | downstream |
| CEP290-1825 | − | AGAGUCUCACUGUGUUGCCCAGG (SEQ ID NO: 2634) | 23 | downstream |
| CEP290-1826 | − | AGUCUCACUGUGUUGCCCAGG (SEQ ID NO: 2635) | 21 | downstream |
| CEP290-1827 | + | CAGUUUUUAAGGCGGGGAGUCACA (SEQ ID NO: 2636) | 24 | downstream |
| CEP290-1828 | − | CUGUCAAAAGCUACCGGUUAC (SEQ ID NO: 2637) | 21 | downstream |
| CEP290-1829 | + | CAUCUCUUGCUCUAGAUGAC (SEQ ID NO: 853) | 20 | downstream |
| CEP290-1830 | − | CACGAAAAUCAGAUUUCAUGU (SEQ ID NO: 2639) | 21 | downstream |
| CEP290-1831 | − | CGAAAAUCAGAUUUCAUGU (SEQ ID NO: 2640) | 19 | downstream |
| CEP290-1832 | − | CUAAUACAUGAGAGUGAUUAGUG (SEQ ID NO: 2641) | 23 | downstream |
| CEP290-1833 | + | CUUGAACUCUGUGCCAAA (SEQ ID NO: 2642) | 18 | downstream |
| CEP290-1834 | + | CUCUAGAUGACAUGAGGUAAG (SEQ ID NO: 2643) | 21 | downstream |
| CEP290-1835 | + | CUAGAUGACAUGAGGUAAG (SEQ ID NO: 2644) | 19 | downstream |
| CEP290-1836 | + | CGGUAGCUUUUGACAGUUUUUAAG (SEQ ID NO: 2645) | 24 | downstream |

TABLE 9E-continued

| gRNA Name | DNA Strand | Targeting Domain | Target Site Length | Position relative to mutation |
|---|---|---|---|---|
| CEP290-1837 | + | CUUUUGACAGUUUUUAAG (SEQ ID NO: 2646) | 18 | downstream |
| CEP290-1838 | + | CUUUUGACAGUUUUUAAGGC (SEQ ID NO: 684) | 20 | downstream |
| CEP290-1839 | + | CAGUAAGGAGGAUGUAAGA (SEQ ID NO: 2648) | 19 | downstream |
| CEP290-1840 | + | CAAAAGACUUAUAUUCCAUUA (SEQ ID NO: 2649) | 21 | downstream |
| CEP290-1841 | − | CUUAGGAAAUUAUUGUUGCUUUUU (SEQ ID NO: 2650) | 24 | downstream |
| CEP290-1842 | − | CUGUGUUGCCCAGGCUGGAGUGCA (SEQ ID NO: 2651) | 24 | downstream |
| CEP290-1843 | − | CAGAGUCUCACUGUGUUGCCCAGG (SEQ ID NO: 2652) | 24 | downstream |
| CEP290-1844 | − | CUCACUGUGUUGCCCAGG (SEQ ID NO: 2653) | 18 | downstream |
| CEP290-1845 | + | GUUUUUAAGGCGGGGAGUCACA (SEQ ID NO: 2654) | 22 | downstream |
| CEP290-1846 | − | GUCAAAAGCUACCGGUUAC (SEQ ID NO: 2655) | 19 | downstream |
| CEP290-1847 | + | GUUCAUCUCUUGCUCUAGAUGAC (SEQ ID NO: 2656) | 23 | downstream |
| CEP290-1848 | − | GGUCACGAAAAUCAGAUUUCAUGU (SEQ ID NO: 2657) | 24 | downstream |
| CEP290-1849 | − | GUCACGAAAAUCAGAUUUCAUGU (SEQ ID NO: 2658) | 23 | downstream |
| CEP290-1850 | − | GAAAAUCAGAUUUCAUGU (SEQ ID NO: 2659) | 18 | downstream |
| CEP290-1851 | − | GCUAAUACAUGAGAGUGAUUAGUG (SEQ ID NO: 2660) | 24 | downstream |
| CEP290-1852 | + | GCUUGAACUCUGUGCCAAA (SEQ ID NO: 2661) | 19 | downstream |
| CEP290-1853 | + | GCUCUAGAUGACAUGAGGUAAG (SEQ ID NO: 2662) | 22 | downstream |
| CEP290-1854 | − | GAUGUAGAUUGAGGUAGAAUCAAG (SEQ ID NO: 2663) | 24 | downstream |
| CEP290-1855 | − | GUAGAUUGAGGUAGAAUCAAG (SEQ ID NO: 2664) | 21 | downstream |
| CEP290-1856 | − | GAUUGAGGUAGAAUCAAG (SEQ ID NO: 2665) | 18 | downstream |
| CEP290-1857 | + | GAUGCAGAACUAGUGUAGA (SEQ ID NO: 2666) | 19 | downstream |
| CEP290-1858 | − | GAUGUAGAUUGAGGUAGAAUC (SEQ ID NO: 2667) | 21 | downstream |
| CEP290-1859 | − | GUAGAUUGAGGUAGAAUC (SEQ ID NO: 2668) | 18 | downstream |
| CEP290-1860 | + | GAAUGAUCAUUCUUGUGGCAGUA (SEQ ID NO: 2669) | 23 | downstream |
| CEP290-1861 | + | GAUCAUUCUUGUGGCAGUA (SEQ ID NO: 2670) | 19 | downstream |

TABLE 9E-continued

| gRNA Name | DNA Strand | Targeting Domain | Target Site Length | Position relative to mutation |
|---|---|---|---|---|
| CEP290-1862 | + | GAAUGAUCAUUCUUGUGGCAGU (SEQ ID NO: 2671) | 22 | downstream |
| CEP290-1863 | + | GAUCAUUCUUGUGGCAGU (SEQ ID NO: 2672) | 18 | downstream |
| CEP290-1864 | - | GAGAGGUAAAGGUUCAUGAGAC (SEQ ID NO: 2673) | 22 | downstream |
| CEP290-1865 | - | GAGGUAAAGGUUCAUGAGAC (SEQ ID NO: 2674) | 20 | downstream |
| CEP290-1866 | - | GGUAAAGGUUCAUGAGAC (SEQ ID NO: 2675) | 18 | downstream |
| CEP290-1867 | + | GGUAGCUUUUGACAGUUUUUAAG (SEQ ID NO: 2676) | 23 | downstream |
| CEP290-1868 | + | GUAGCUUUUGACAGUUUUUAAG (SEQ ID NO: 2677) | 22 | downstream |
| CEP290-1869 | + | GCUUUUGACAGUUUUUAAG (SEQ ID NO: 2678) | 19 | downstream |
| CEP290-1870 | + | GUAGCUUUUGACAGUUUUUAAGGC (SEQ ID NO: 2679) | 24 | downstream |
| CEP290-1871 | + | GCUUUUGACAGUUUUUAAGGC (SEQ ID NO: 2680) | 21 | downstream |
| CEP290-1872 | + | GAAAUUCACUGAGCAAAACAAC (SEQ ID NO: 2681) | 22 | downstream |
| CEP290-1873 | + | GUGGCAGUAAGGAGGAUGUAAGA (SEQ ID NO: 2682) | 23 | downstream |
| CEP290-1874 | + | GGCAGUAAGGAGGAUGUAAGA (SEQ ID NO: 2683) | 21 | downstream |
| CEP290-1875 | + | GCAGUAAGGAGGAUGUAAGA (SEQ ID NO: 775) | 20 | downstream |
| CEP290-1876 | - | GGAAAUUAUUGUUGCUUUUU (SEQ ID NO: 2685) | 20 | downstream |
| CEP290-1877 | - | GAAAUUAUUGUUGCUUUUU (SEQ ID NO: 2686) | 19 | downstream |
| CEP290-1878 | - | GAAAAACUUGAAAUUUGAUAG (SEQ ID NO: 2687) | 21 | downstream |
| CEP290-1879 | - | GAAGAAAAAGAAAUAGAUGUAGA (SEQ ID NO: 2688) | 24 | downstream |
| CEP290-1880 | - | GAAAAAGAAAUAGAUGUAGA (SEQ ID NO: 2689) | 21 | downstream |
| CEP290-1881 | - | GUGUUGCCCAGGCUGGAGUGCA (SEQ ID NO: 2690) | 22 | downstream |
| CEP290-1882 | - | GUUGCCCAGGCUGGAGUGCA (SEQ ID NO: 2691) | 20 | downstream |
| CEP290-1883 | - | GAGUCUCACUGUGUUGCCCAGG (SEQ ID NO: 2692) | 22 | downstream |
| CEP290-1884 | - | GUCUCACUGUGUUGCCCAGG (SEQ ID NO: 2693) | 20 | downstream |
| CEP290-1885 | + | UUUUUAAGGCGGGGAGUCACA (SEQ ID NO: 2694) | 21 | downstream |
| CEP290-1886 | + | UUUUAAGGCGGGGAGUCACA (SEQ ID NO: 672) | 20 | downstream |

TABLE 9E-continued

| gRNA Name | DNA Strand | Targeting Domain | Target Site Length | Position relative to mutation |
|---|---|---|---|---|
| CEP290-1887 | + | UUUAAGGCGGGGAGUCACA (SEQ ID NO: 2696) | 19 | downstream |
| CEP290-1888 | + | UUAAGGCGGGGAGUCACA (SEQ ID NO: 2697) | 18 | downstream |
| CEP290-1889 | − | UGUCAAAAGCUACCGGUUAC (SEQ ID NO: 757) | 20 | downstream |
| CEP290-1890 | − | UCAAAAGCUACCGGUUAC (SEQ ID NO: 2699) | 18 | downstream |
| CEP290-1891 | + | UUCAUCUCUUGCUCUAGAUGAC (SEQ ID NO: 2700) | 22 | downstream |
| CEP290-1892 | + | UCAUCUCUUGCUCUAGAUGAC (SEQ ID NO: 2701) | 21 | downstream |
| CEP290-1893 | + | UCUCUUGCUCUAGAUGAC (SEQ ID NO: 2702) | 18 | downstream |
| CEP290-1894 | − | UCACGAAAAUCAGAUUUCAUGU (SEQ ID NO: 2703) | 22 | downstream |
| CEP290-1895 | − | UAAUACAUGAGAGUGAUUAGUG (SEQ ID NO: 2704) | 22 | downstream |
| CEP290-1896 | − | UACAUGAGAGUGAUUAGUG (SEQ ID NO: 2705) | 19 | downstream |
| CEP290-1897 | + | UAUUAGCUUGAACUCUGUGCCAAA (SEQ ID NO: 2706) | 24 | downstream |
| CEP290-1898 | + | UUAGCUUGAACUCUGUGCCAAA (SEQ ID NO: 2707) | 22 | downstream |
| CEP290-1899 | + | UAGCUUGAACUCUGUGCCAAA (SEQ ID NO: 2708) | 21 | downstream |
| CEP290-1900 | + | UUGCUCUAGAUGACAUGAGGUAAG (SEQ ID NO: 2709) | 24 | downstream |
| CEP290-1901 | + | UGCUCUAGAUGACAUGAGGUAAG (SEQ ID NO: 2710) | 23 | downstream |
| CEP290-1902 | + | UCUAGAUGACAUGAGGUAAG (SEQ ID NO: 888) | 20 | downstream |
| CEP290-1903 | + | UAGAUGACAUGAGGUAAG (SEQ ID NO: 2712) | 18 | downstream |
| CEP290-1904 | − | UGUAGAUUGAGGUAGAAUCAAG (SEQ ID NO: 2713) | 22 | downstream |
| CEP290-1905 | − | UAGAUUGAGGUAGAAUCAAG (SEQ ID NO: 2714) | 20 | downstream |
| CEP290-1906 | + | UAUAAGAUGCAGAACUAGUGUAGA (SEQ ID NO: 2715) | 24 | downstream |
| CEP290-1907 | + | UAAGAUGCAGAACUAGUGUAGA (SEQ ID NO: 2716) | 22 | downstream |
| CEP290-1908 | − | UAGAUGUAGAUUGAGGUAGAAUC (SEQ ID NO: 2717) | 23 | downstream |
| CEP290-1909 | − | UGUAGAUUGAGGUAGAAUC (SEQ ID NO: 2718) | 19 | downstream |
| CEP290-1910 | + | UGAUCAUUCUUGUGGCAGUA (SEQ ID NO: 688) | 20 | downstream |
| CEP290-1911 | + | UAGAAUGAUCAUUCUUGUGGCAGU (SEQ ID NO: 2720) | 24 | downstream |

TABLE 9E-continued

| gRNA Name | DNA Strand | Targeting Domain | Target Site Length | Position relative to mutation |
|---|---|---|---|---|
| CEP290-1912 | + | UGAUCAUUCUUGUGGCAGU (SEQ ID NO: 2721) | 19 | downstream |
| CEP290-1913 | – | UUGAGAGGUAAAGGUUCAUGAGAC (SEQ ID NO: 2722) | 24 | downstream |
| CEP290-1914 | – | UGAGAGGUAAAGGUUCAUGAGAC (SEQ ID NO: 2723) | 23 | downstream |
| CEP290-1915 | + | UAGCUUUUGACAGUUUUUAAG (SEQ ID NO: 2724) | 21 | downstream |
| CEP290-1916 | + | UAGCUUUUGACAGUUUUUAAGGC (SEQ ID NO: 2725) | 23 | downstream |
| CEP290-1917 | + | UUUUGACAGUUUUUAAGGC (SEQ ID NO: 2726) | 19 | downstream |
| CEP290-1918 | + | UUUGACAGUUUUUAAGGC (SEQ ID NO: 2727) | 18 | downstream |
| CEP290-1919 | + | UAGAAAUUCACUGAGCAAAACAAC (SEQ ID NO: 2728) | 24 | downstream |
| CEP290-1920 | + | UUCACUGAGCAAAACAAC (SEQ ID NO: 2729) | 18 | downstream |
| CEP290-1921 | + | UGUGGCAGUAAGGAGGAUGUAAGA (SEQ ID NO: 2730) | 24 | downstream |
| CEP290-1922 | + | UGGCAGUAAGGAGGAUGUAAGA (SEQ ID NO: 2731) | 22 | downstream |
| CEP290-1923 | + | UAUCAAAAGACUUAUAUUCCAUUA (SEQ ID NO: 2732) | 24 | downstream |
| CEP290-1924 | + | UCAAAAGACUUAUAUUCCAUUA (SEQ ID NO: 2733) | 22 | downstream |
| CEP290-1925 | – | UUAGGAAAUUAUUGUUGCUUUUU (SEQ ID NO: 2734) | 23 | downstream |
| CEP290-1926 | – | UAGGAAAUUAUUGUUGCUUUUU (SEQ ID NO: 2735) | 22 | downstream |
| CEP290-1927 | – | UGUGUUGCCCAGGCUGGAGUGCA (SEQ ID NO: 2736) | 23 | downstream |
| CEP290-1928 | – | UGUUGCCCAGGCUGGAGUGCA (SEQ ID NO: 2737) | 21 | downstream |
| CEP290-1929 | – | UUGCCCAGGCUGGAGUGCA (SEQ ID NO: 2738) | 19 | downstream |
| CEP290-1930 | – | UGCCCAGGCUGGAGUGCA (SEQ ID NO: 2739) | 18 | downstream |
| CEP290-1931 | – | UCUCACUGUGUUGCCCAGG (SEQ ID NO: 2740) | 19 | downstream |
| CEP290-13 | + | AUGAGAUACUCACAAUUACAAC (SEQ ID NO: 1049) | 22 | upstream |
| CEP290-18 | + | GUAUGAGAUACUCACAAUUACAAC (SEQ ID NO: 1051) | 24 | upstream |
| CEP290-14 | + | UAUGAGAUACUCACAAUUACAAC (SEQ ID NO: 1053) | 23 | upstream |
| CEP290-19 | + | GGUAUGAGAUAUUCACAAUUACAA (SEQ ID NO: 1057) | 24 | upstream |

Table 10A provides targeting domains for break-induced deletion of genomic sequence including the mutation at the LCA10 target position in the CEP290 gene selected according to the first tier parameters. The targeting domains are within 1000 bp upstream of an Alu repeat, within 40 bp upstream of mutation, or 1000 bp downstream of the mutation, have good orthogonality, and start with G. It is contemplated herein that the targeting domain hybridizes to the target domain through complementary base pairing. Any of the targeting domains in the table can be used with a *N. meningitidis* Cas9 molecule that generates a double stranded break (Cas9 nuclease) or a single-stranded break (Cas9 nickase).

TABLE 10A

| gRNA Name | DNA Strand | Targeting Domain | Target Site Length | Position relative to mutation |
|---|---|---|---|---|
| CEP290-1932 | + | GGCAAAAGCAGCAGAAAGCA (SEQ ID NO: 591) | 20 | upstream |
| CEP290-1933 | − | GUGGCUGAAUGACUUCU (SEQ ID NO: 592) | 17 | upstream |
| CEP290-1934 | − | GUUGUUCUGAGUAGCUU (SEQ ID NO: 590) | 17 | upstream |
| CEP290-1935 | − | GACUAGAGGUCACGAAA (SEQ ID NO: 593) | 17 | downstream |
| CEP290-1936 | − | GAGUUCAAGCUAAUACAUGA (SEQ ID NO: 589) | 20 | downstream |

Table 10B provides targeting domains for break-induced deletion of genomic sequence including the mutation at the LCA10 target position in the CEP290 gene selected according to the second tier parameters. The targeting domains are within 1000 bp upstream of an Alu repeat, within 40 bp upstream of mutation, or 1000 bp downstream of the mutation, have good orthogonality, and do not start with G. It is contemplated herein that the targeting domain hybridizes to the target domain through complementary base pairing. Any of the targeting domains in the table can be used with a *N. meningitidis* Cas9 molecule that generates a double stranded break (Cas9 nuclease) or a single-stranded break (Cas9 nickase).

TABLE 10B

| gRNA Name | DNA Strand | Targeting Domain | Target Site Length | Position relative to mutation |
|---|---|---|---|---|
| CEP290-1937 | + | AAAAGCAGCAGAAAGCA (SEQ ID NO: 1012) | 17 | upstream |
| CEP290-1938 | − | AACGUUGUUCUGAGUAGCUU (SEQ ID NO: 1014) | 20 | upstream |
| CEP290-1939 | − | AAUAGAGGCUUAUGGAU (SEQ ID NO: 1007) | 17 | upstream |
| CEP290-1940 | + | ACUUAAUGAGUGCUUCCCUC (SEQ ID NO: 2748) | 20 | upstream |
| CEP290-1941 | − | AGAAAUAGAGGCUUAUGGAU (SEQ ID NO: 1016) | 20 | upstream |
| CEP290-1942 | + | AGCAGAAAGCAAACUGA (SEQ ID NO: 1011) | 17 | upstream |
| CEP290-1943 | + | AGCAGCAGAAAGCAAACUGA (SEQ ID NO: 1018) | 20 | upstream |
| CEP290-1944 | + | AGGGUCUGGUCCAUAUU (SEQ ID NO: 2752) | 17 | upstream |
| CEP290-1945 | − | AUAGUGGCUGAAUGACUUCU (SEQ ID NO: 2753) | 20 | upstream |

TABLE 10B-continued

| gRNA Name | DNA Strand | Targeting Domain | Target Site Length | Position relative to mutation |
|---|---|---|---|---|
| CEP290-1946 | + | AUGUCUGGUUAAAAGAG (SEQ ID NO: 2754) | 17 | upstream |
| CEP290-1947 | + | CAAAGGGUCUGGUCCAUAUU (SEQ ID NO: 2755) | 20 | upstream |
| CEP290-1948 | − | CAUCAGAAAUAGAGGCU (SEQ ID NO: 1009) | 17 | upstream |
| CEP290-1949 | − | CCUCAUCAGAAAUAGAGGCU (SEQ ID NO: 1017) | 20 | upstream |
| CEP290-1950 | − | CUGAGGACAGAACAAGC (SEQ ID NO: 1008) | 17 | upstream |
| CEP290-1951 | − | CUGCUGCUUUUGCCAAAGAG (SEQ ID NO: 725) | 20 | upstream |
| CEP290-1952 | − | CUGCUUUUGCCAAAGAG (SEQ ID NO: 711) | 17 | upstream |
| CEP290-1953 | + | UAAUGAGUGCUUCCCUC (SEQ ID NO: 2761) | 17 | upstream |
| CEP290-1954 | + | UAGAUGUCUGGUUAAAAGAG (SEQ ID NO: 2762) | 20 | upstream |
| CEP290-1955 | − | UCAUUCUCCUUAGGUCACUU (SEQ ID NO: 2763) | 20 | upstream |
| CEP290-1956 | − | UUACUGAGGACAGAACAAGC (SEQ ID NO: 1013) | 20 | upstream |
| CEP290-1957 | − | UUCUCCUUAGGUCACUU (SEQ ID NO: 2765) | 17 | upstream |
| CEP290-1958 | − | AAGAAAAAGAAAUAGA (SEQ ID NO: 2766) | 17 | downstream |
| CEP290-1959 | − | AGAUUGAGGUAGAAUCAAGA (SEQ ID NO: 2767) | 20 | downstream |
| CEP290-1960 | + | AGUCACAUGGGAGUCACAGG (SEQ ID NO: 1006) | 20 | downstream |
| CEP290-1961 | + | CAAAAAAAGAAUCCUCU (SEQ ID NO: 2769) | 17 | downstream |
| CEP290-1962 | + | CAACAAAAAAGAAUCCUCU (SEQ ID NO: 2770) | 20 | downstream |
| CEP290-1963 | + | CACAUGGGAGUCACAGG (SEQ ID NO: 1005) | 17 | downstream |
| CEP290-1964 | + | CAUUCUUCACACAUGAA (SEQ ID NO: 2772) | 17 | downstream |
| CEP290-1965 | − | UAGAAGAAAAAGAAAUAGA (SEQ ID NO: 2773) | 20 | downstream |
| CEP290-1966 | − | UGAGACUAGAGGUCACGAAA (SEQ ID NO: 2774) | 20 | downstream |
| CEP290-1967 | − | UUCAAGCUAAUACAUGA (SEQ ID NO: 1004) | 17 | downstream |
| CEP290-1968 | + | UUCCAUUCUUCACACAUGAA (SEQ ID NO: 2776) | 20 | downstream |
| CEP290-1969 | − | UUGAGGUAGAAUCAAGA (SEQ ID NO: 2777) | 17 | downstream |

Table 11 provides targeting domains for break-induced deletion of genomic sequence including the mutation at the LCA10 target position in the CEP290 gene by dual targeting (e.g., dual double strand cleavage). Exemplary gRNA pairs to be used with *S. aureus* Cas9 are shown in Table 11, e.g., CEP290-323 can be combined with CEP290-11, CEP290-323 can be combined with CEP290-64, CEP290-490 can be combined with CEP290-496, CEP290-490 can be combined with CEP290-502, CEP290-490 can be combined with CEP290-504, CEP290-492 can be combined with CEP290-502, or CEP290-492 can be combined with CEP290-504.

TABLE 11

| Upstream gRNA (SEQ ID NO) | | Downstream gRNA (SEQ ID NO) | |
|---|---|---|---|
| CEP290-323 | GTTCTGTCCTCAGTAAAAGGTA (SEQ ID NO: 389) (corresponding RNA sequence in SEQ ID NO: 530) | CEP290-11 | GACACTGCCAATAGGG ATAGGT (SEQ ID NO: 387) (corresponding RNA sequence in SEQ ID NO: 1047) |
| CEP290-323 | GTTCTGTCCTCAGTAAAAGGTA (SEQ ID NO: 389) | CEP290-64 | GTCAAAAGCTACCGGT TACCTG (SEQ ID NO: 388) (corresponding RNA sequence in SEQ ID NO: 558) |
| CEP290-490 | GAATAGTTTGTTCTGGGTAC (SEQ ID NO: 390) (corresponding RNA sequence in SEQ ID NO: 468) | CEP290-496 | GATGCAGAACTAGTGT AGAC (SEQ ID NO: 392) (corresponding RNA sequence in SEQ ID NO: 460) |
| CEP290-490 | GAATAGTTTGTTCTGGGTAC (SEQ ID NO: 390) | CEP290-502 | GTCACATGGGAGTCAC AGGG (SEQ ID NO: 393) (corresponding RNA sequence in SEQ ID NO: 586) |
| CEP290-490 | GAATAGTTTGTTCTGGGTAC (SEQ ID NO: 390) | CEP290-504 | GAGTATCTCCTGTTTGG CA (SEQ ID NO: 394) (corresponding RNA sequence in SEQ ID NO: 568) |
| CEP290-492 | GAGAAAGGGATGGGCACTTA (SEQ ID NO: 391) (corresponding RNA sequence in SEQ ID NO: 538) | CEP290-502 | GTCACATGGGAGTCAC AGGG (SEQ ID NO: 393) |
| CEP290-492 | GAGAAAGGGATGGGCACTTA (SEQ ID NO: 391) | CEP290-504 | GAGTATCTCCTGTTTGG CA (SEQ ID NO: 394) |

IV. RNA-Guided Nucleases

RNA-guided nucleases according to the present disclosure include, without limitation, naturally-occurring Class 2 CRISPR nucleases such as Cas9, and Cpf1, as well as other nucleases derived or obtained therefrom. In functional terms, RNA-guided nucleases are defined as those nucleases that: (a) interact with (e.g., complex with) a gRNA; and (b) together with the gRNA, associate with, and optionally cleave or modify, a target region of a DNA that includes (i) a sequence complementary to the targeting domain of the gRNA and, optionally, (ii) an additional sequence referred to as a "protospacer adjacent motif," or "PAM," which is described in greater detail below. As the following examples will illustrate, RNA-guided nucleases can be defined, in broad terms, by their PAM specificity and cleavage activity, even though variations may exist between individual RNA-guided nucleases that share the same PAM specificity or cleavage activity. Skilled artisans will appreciate that some aspects of the present disclosure relate to systems, methods and compositions that can be implemented using any suitable RNA-guided nuclease having a certain PAM specificity and/or cleavage activity. For this reason, unless otherwise specified, the term RNA-guided nuclease should be understood as a generic term, and not limited to any particular type (e.g., Cas9 vs. Cpf1), species (e.g., *S. pyogenes* vs. *S. aureus*) or variation (e.g., full-length vs. truncated or split; naturally-occurring PAM specificity vs. engineered PAM specificity).

Turning to the PAM sequence, this structure takes its name from its sequential relationship to the "protospacer" sequence that is complementary to gRNA targeting domains (or "spacers"). Together with protospacer sequences, PAM sequences define target regions or sequences for specific RNA-guided nuclease/gRNA combinations.

Various RNA-guided nucleases may require different sequential relationships between PAMs and protospacers. In general, Cas9s recognize PAM sequences that are 5' of the protospacer as visualized relative to the top or complementary strand.

In addition to recognizing specific sequential orientations of PAMs and protospacers, RNA-guided nucleases generally recognize specific PAM sequences. *S. aureus* Cas9, for example, recognizes a PAM sequence of NNGRRT, wherein the N sequences are immediately 3' of the region recognized by the gRNA targeting domain. *S. pyogenes* Cas9 recognizes NGG PAM sequences. It should also be noted that engineered RNA-guided nucleases can have PAM specificities that differ from the PAM specificities of similar nucleases (such as the naturally occurring variant from which an RNA-guided nuclease is derived, or the naturally occurring variant having the greatest amino acid sequence homology to an engineered RNA-guided nuclease). Modified Cas9s that recognize alternate PAM sequences are described below.

RNA-guided nucleases are also characterized by their DNA cleavage activity: naturally-occurring RNA-guided nucleases typically form DSBs in target nucleic acids, but engineered variants have been produced that generate only SSBs (discussed above; see also Ran 2013, incorporated by reference herein), or that do not cut at all.

Cas9 Molecules

Crystal structures have been determined for S. pyogenes Cas9 (Jinek 2014), and for S. aureus Cas9 in complex with a unimolecular gRNA and a target DNA (Nishimasu 2014; Anders 2014; and Nishimasu 2015).

Cas9 molecules of a variety of species can be used in the methods and compositions described herein. While the S. pyogenes, S. aureus, and S. thermophilus Cas9 molecules are the subject of much of the disclosure herein, Cas9 molecules of, derived from, or based on the Cas9 proteins of other species listed herein can be used as well. In other words, while the much of the description herein uses S. pyogenes and S. thermophilus Cas9 molecules Cas9 molecules from the other species can replace them. Such species include: Acidovorax avenae, Actinobacillus pleuropneumoniae, Actinobacillus succinogenes, Actinobacillus suis, Actinomyces sp., Cycliphilus denitrificans, Aminomonas paucivorans, Bacillus cereus, Bacillus smithii, Bacillus thuringiensis, Bacteroides sp., Blastopirellula marina, Bradyrhizobium sp., Brevibacillus laterosporus, Campylobacter coli, Campylobacter jejuni, Campylobacter lari, Candidatus puniceispirillum, Clostridium cellulolyticum, Clostridium perfringens, Corynebacterium accolens, Corynebacterium diphtheria, Corynebacterium matruchotii, Dinoroseobacter shibae, Eubacterium dolichum, Gamma proteobacterium, Gluconacetobacter diazotrophicus, Haemophilus parainfluenzae, Haemophilus sputorum, Helicobacter canadensis, Helicobacter cinaedi, Helicobacter mustelae, Ilyobacter polytropus, Kingella kingae, Lactobacillus crispatus, Listeria ivanovii, Listeria monocytogenes, Listeriaceae bacterium, Methylocystis sp., Methylosinus trichosporium, Mobiluncus mulieris, Neisseria bacilliformis, Neisseria cinerea, Neisseria flavescens, Neisseria lactamica, Neisseria meningitidis, Neisseria sp., Neisseria wadsworthii, Nitrosomonas sp., Parvibaculum lavamentivorans, Pasteurella multocida, Phascolarctobacterium succinatutens, Ralstonia syzygii, Rhodopseudomonas palustris, Rhodovulum sp., Simonsiella muelleri, Sphingomonas sp., Sporolactobacillus vineae, Staphylococcus aureus, Staphylococcus lugdunensis, Streptococcus sp., Subdoligranulum sp., Tistrella mobilis, Treponema sp., or Verminephrobacter eiseniae.

A Cas9 molecule, or Cas9 polypeptide, as that term is used herein, refers to a molecule or polypeptide that can interact with a guide RNA (gRNA) molecule and, in concert with the gRNA molecule, homes or localizes to a site which comprises a target domain and PAM sequence. Cas9 molecule and Cas9 polypeptide, as those terms are used herein, refer to naturally occurring Cas9 molecules and to engineered, altered, or modified Cas9 molecules or Cas9 polypeptides that differ, e.g., by at least one amino acid residue, from a reference sequence, e.g., the most similar naturally occurring Cas9 molecule or a sequence of Table 12.

Cas9 Domains

Crystal structures have been determined for two different naturally occurring bacterial Cas9 molecules (Jinek 2014) and for S. pyogenes Cas9 with a guide RNA (e.g., a synthetic fusion of crRNA and tracrRNA) (Nishimasu 2014; Anders 2014).

A naturally occurring Cas9 molecule comprises two lobes: a recognition (REC) lobe and a nuclease (NUC) lobe; each of which further comprises domains described herein. FIGS. 8A-8B provide a schematic of the organization of important Cas9 domains in the primary structure. The domain nomenclature and the numbering of the amino acid residues encompassed by each domain used throughout this disclosure is as described in Nishimasu 2014. The numbering of the amino acid residues is with reference to Cas9 from S. pyogenes.

The REC lobe comprises the arginine-rich bridge helix (BH), the REC1 domain, and the REC2 domain. The REC lobe does not share structural similarity with other known proteins, indicating that it is a Cas9-specific functional domain. The BH domain is a long a helix and arginine rich region and comprises amino acids 60-93 of the sequence of S. pyogenes Cas9. The REC1 domain is important for recognition of the repeat:anti-repeat duplex, e.g., of a gRNA or a tracrRNA, and is therefore critical for Cas9 activity by recognizing the target sequence. The REC1 domain comprises two REC1 motifs at amino acids 94 to 179 and 308 to 717 of the sequence of S. pyogenes Cas9. These two REC1 domains, though separated by the REC2 domain in the linear primary structure, assemble in the tertiary structure to form the REC1 domain. The REC2 domain, or parts thereof, may also play a role in the recognition of the repeat:anti-repeat duplex. The REC2 domain comprises amino acids 180-307 of the sequence of S. pyogenes Cas9.

The NUC lobe comprises the RuvC domain (also referred to herein as RuvC-like domain), the HNH domain (also referred to herein as HNH-like domain), and the PAM-interacting (PI) domain. The RuvC domain shares structural similarity to retroviral integrase superfamily members and cleaves a single strand, e.g., the non-complementary strand of the target nucleic acid molecule. The RuvC domain is assembled from the three split RuvC motifs (RuvC I, RuvCII, and RuvCIII, which are often commonly referred to in the art as RuvCI domain, or N-terminal RuvC domain, RuvCII domain, and RuvCIII domain) at amino acids 1-59, 718-769, and 909-1098, respectively, of the sequence of S. pyogenes Cas9. Similar to the REC1 domain, the three RuvC motifs are linearly separated by other domains in the primary structure, however in the tertiary structure, the three RuvC motifs assemble and form the RuvC domain. The HNH domain shares structural similarity with HNH endonucleases, and cleaves a single strand, e.g., the complementary strand of the target nucleic acid molecule. The HNH domain lies between the RuvC II-III motifs and comprises amino acids 775-908 of the sequence of S. pyogenes Cas9. The PI domain interacts with the PAM of the target nucleic acid molecule, and comprises amino acids 1099-1368 of the sequence of S. pyogenes Cas9.

RuvC-Like Domain and HNH-Like Domain

In an embodiment, a Cas9 molecule or Cas9 polypeptide comprises an HNH-like domain and a RuvC-like domain. In an embodiment, cleavage activity is dependent on a RuvC-like domain and an HNH-like domain. A Cas9 molecule or Cas9 polypeptide, e.g., an eaCas9 molecule or eaCas9 polypeptide, can comprise one or more of the following domains: a RuvC-like domain and an HNH-like domain. In an embodiment, a Cas9 molecule or Cas9 polypeptide is an eaCas9 molecule or eaCas9 polypeptide and the eaCas9 molecule or eaCas9 polypeptide comprises a RuvC-like domain, e.g., a RuvC-like domain described below, and/or an HNH-like domain, e.g., an HNH-like domain described below.

RuvC-Like Domains

In an embodiment, a RuvC-like domain cleaves, a single strand, e.g., the non-complementary strand of the target nucleic acid molecule. The Cas9 molecule or Cas9 polypeptide can include more than one RuvC-like domain (e.g., one, two, three or more RuvC-like domains). In an embodiment, a RuvC-like domain is at least 5, 6, 7, 8 amino acids in length but not more than 20, 19, 18, 17, 16 or 15 amino acids in length. In an embodiment, the Cas9 molecule or Cas9 polypeptide comprises an N-terminal RuvC-like domain of about 10 to 20 amino acids, e.g., about 15 amino acids in length.

N-Terminal RuvC-Like Domains

Some naturally occurring Cas9 molecules comprise more than one RuvC-like domain with cleavage being dependent on the N-terminal RuvC-like domain. Accordingly, Cas9 molecules or Cas9 polypeptide can comprise an N-terminal RuvC-like domain. Exemplary N-terminal RuvC-like domains are described below.

In an embodiment, an eaCas9 molecule or eaCas9 polypeptide comprises an N-terminal RuvC-like domain comprising an amino acid sequence of formula I:

```
                              (SEQ ID NO: 8)
D-X1-G-X2-X3-X4-X5-G-X6-X7-X8-X9,
``` wherein,

X1 is selected from I, V, M, L and T (e.g., selected from I, V, and L);

X2 is selected from T, I, V, S, N, Y, E and L (e.g., selected from T, V, and I);

X3 is selected from N, S, G, A, D, T, R, M and F (e.g., A or N);

X4 is selected from S, Y, N and F (e.g., S);

X5 is selected from V, I, L, C, T and F (e.g., selected from V, I and L);

X6 is selected from W, F, V, Y, S and L (e.g., W);

X7 is selected from A, S, C, V and G (e.g., selected from A and S);

X8 is selected from V, I, L, A, M and H (e.g., selected from V, I, M and L); and X9 is selected from any amino acid or is absent, designated by Δ (e.g., selected from T, V, I, L, Δ, F, S, A, Y, M and R, or, e.g., selected from T, V, I, L and Δ).

In an embodiment, the N-terminal RuvC-like domain differs from a sequence of SEQ ID NO: 8, by as many as 1 but no more than 2, 3, 4, or 5 residues.

In embodiment, the N-terminal RuvC-like domain is cleavage competent.

In embodiment, the N-terminal RuvC-like domain is cleavage incompetent.

In an embodiment, a eaCas9 molecule or eaCas9 polypeptide comprises an N-terminal RuvC-like domain comprising an amino acid sequence of formula II:

```
                            (SEQ ID NO: 9)
D-X1-G-X2-X3-S-X5-G-X6-X7-X8-X9,,
``` wherein

X1 is selected from I, V, M, L and T (e.g., selected from I, V, and L);

X2 is selected from T, I, V, S, N, Y, E and L (e.g., selected from T, V, and I);

X3 is selected from N, S, G, A, D, T, R, M and F (e.g., A or N);

X5 is selected from V, I, L, C, T and F (e.g., selected from V, I and L);

X6 is selected from W, F, V, Y, S and L (e.g., W);

X7 is selected from A, S, C, V and G (e.g., selected from A and S);

X8 is selected from V, I, L, Δ, M and H (e.g., selected from V, I, M and L); and X9 is selected from any amino acid or is absent (e.g., selected from T, V, I, L, Δ, F, S, A, Y, M and R or selected from e.g., T, V, I, L and A).

In an embodiment, the N-terminal RuvC-like domain differs from a sequence of SEQ ID NO:9 by as many as 1 but no more than 2, 3, 4, or 5 residues.

In an embodiment, the N-terminal RuvC-like domain comprises an amino acid sequence of formula III:

```
                         (SEQ ID NO: 10)
D-I-G-X2-X3-S-V-G-W-A-X8-X9,
``` wherein

X2 is selected from T, I, V, S, N, Y, E and L (e.g., selected from T, V, and I);

X3 is selected from N, S, G, A, D, T, R, M and F (e.g., A or N);

X8 is selected from V, I, L, Δ, M and H (e.g., selected from V, I, M and L); and X9 is selected from any amino acid or is absent (e.g., selected from T, V, I, L, Δ, F, S, A, Y, M and R or selected from e.g., T, V, I, L and Δ).

In an embodiment, the N-terminal RuvC-like domain differs from a sequence of SEQ ID NO: 10 by as many as 1 but no more than, 2, 3, 4, or 5 residues.

In an embodiment, the N-terminal RuvC-like domain comprises an amino acid sequence of formula III:

```
                         (SEQ ID NO: 11)
D-I-G-T-N-S-V-G-W-A-V-X,
``` wherein

X is a non-polar alkyl amino acid or a hydroxyl amino acid, e.g., X is selected from V, I, L and T (e.g., the eaCas9 molecule can comprise an N-terminal RuvC-like domain shown in FIGS. 2A-2G (is depicted as Y)).

In an embodiment, the N-terminal RuvC-like domain differs from a sequence of SEQ ID NO: 11 by as many as 1 but no more than, 2, 3, 4, or 5 residues.

In an embodiment, the N-terminal RuvC-like domain differs from a sequence of an N-terminal RuvC like domain disclosed herein, e.g., in FIGS. 3A-3B or FIGS. 7A-7B, as many as 1 but no more than 2, 3, 4, or 5 residues. In an embodiment, 1, 2, or all 3 of the highly conserved residues identified in FIGS. 3A-3B or FIGS. 7A-7B are present.

In an embodiment, the N-terminal RuvC-like domain differs from a sequence of an N-terminal RuvC-like domain disclosed herein, e.g., in FIGS. 4A-4B or FIGS. 7A-7B, as many as 1 but no more than 2, 3, 4, or 5 residues. In an embodiment, 1, 2, 3 or all 4 of the highly conserved residues identified in FIGS. 4A-4B or FIGS. 7A-7B are present.

Additional RuvC-Like Domains

In addition to the N-terminal RuvC-like domain, the Cas9 molecule or Cas9 polypeptide, e.g., an eaCas9 molecule or eaCas9 polypeptide, can comprise one or more additional RuvC-like domains. In an embodiment, the Cas9 molecule or Cas9 polypeptide can comprise two additional RuvC-like domains. Preferably, the additional RuvC-like domain is at least 5 amino acids in length and, e.g., less than 15 amino acids in length, e.g., 5 to 10 amino acids in length, e.g., 8 amino acids in length.

An additional RuvC-like domain can comprise an amino acid sequence:

I-X1-X2-E-X3-A-R-E (SEQ ID NO: 12), wherein
X1 is V or H,
X2 is I, L or V (e.g., I or V); and
X3 is M or T.

In an embodiment, the additional RuvC-like domain comprises the amino acid sequence:

I-V-X2-E-M-A-R-E (SEQ ID NO: 13), wherein
X2 is I, L or V (e.g., I or V) (e.g., the eaCas9 molecule or eaCas9 polypeptide can comprise an additional RuvC-like domain shown in FIG. 2A-2G or FIGS. 7A-7B (depicted as B)).

An additional RuvC-like domain can comprise an amino acid sequence:

H-H-A-X1-D-A-X2-X3 (SEQ ID NO: 14), wherein
X1 is H or L;
X2 is R or V; and
X3 is E or V.

In an embodiment, the additional RuvC-like domain comprises the amino acid sequence: H-H-A-H-D-A-Y-L (SEQ ID NO: 15).

In an embodiment, the additional RuvC-like domain differs from a sequence of SEQ ID NOs: 13, 15, 12 or 14 by as many as 1 but no more than 2, 3, 4, or 5 residues.

In some embodiments, the sequence flanking the N-terminal RuvC-like domain is a sequences of formula V:

```
                                              (SEQ ID NO: 16)
     K-X1'-Y-X2'-X3'-X4'-Z-T-D-X9'-Y,.
``` wherein
X1' is selected from K and P,
X2' is selected from V, L, I, and F (e.g., V, I and L);
X3' is selected from G, A and S (e.g., G),
X4' is selected from L, I, V and F (e.g., L);
X9' is selected from D, E, N and Q; and
Z is an N-terminal RuvC-like domain, e.g., as described above.

HNH-Like Domains

In an embodiment, an HNH-like domain cleaves a single stranded complementary domain, e.g., a complementary strand of a double stranded nucleic acid molecule. In an embodiment, an HNH-like domain is at least 15, 20, 25 amino acids in length but not more than 40, 35 or 30 amino acids in length, e.g., 20 to 35 amino acids in length, e.g., 25 to 30 amino acids in length. Exemplary HNH-like domains are described below.

In an embodiment, an eaCas9 molecule or eaCas9 polypeptide comprises an HNH-like domain having an amino acid sequence of formula VI:

X1-X2-X3-H-X4-X5-P-X6-X7-X8-X9-X10-X11-X12-X13-X14-X15-N-X16-X17-X18-X19-X20-X21-X22-X23-N(SEQ ID NO: 17), wherein X1 is selected from D, E, Q and N (e.g., D and E);
X2 is selected from L, I, R, Q, V, M and K;
X3 is selected from D and E;
X4 is selected from I, V, T, A and L (e.g., A, I and V);
X5 is selected from V, Y, I, L, F and W (e.g., V, I and L);
X6 is selected from Q, H, R, K, Y, I, L, F and W;
X7 is selected from S, A, D, T and K (e.g., S and A);
X8 is selected from F, L, V, K, Y, M, I, R, A, E, D and Q (e.g., F);
X9 is selected from L, R, T, I, V, S, C, Y, K, F and G;
X10 is selected from K, Q, Y, T, F, L, W, M, A, E, G, and S;
X11 is selected from D, S, N, R, L and T (e.g., D);
X12 is selected from D, N and S;
X13 is selected from S, A, T, G and R (e.g., S);
X14 is selected from I, L, F, S, R, Y, Q, W, D, K and H (e.g., I, L and F);
X15 is selected from D, S, I, N, E, A, H, F, L, Q, M, G, Y and V;
X16 is selected from K, L, R, M, T and F (e.g., L, R and K);
X17 is selected from V, L, I, A and T;
X18 is selected from L, I, V and A (e.g., L and I);
X19 is selected from T, V, C, E, S and A (e.g., T and V);
X20 is selected from R, F, T, W, E, L, N, C, K, V, S, Q, I, Y, H and A;
X21 is selected from S, P, R, K, N, A, H, Q, G and L;
X22 is selected from D, G, T, N, S, K, A, I, E, L, Q, R and Y; and
X23 is selected from K, V, A, E, Y, I, C, L, S, T, G, K, M, D and F.

In an embodiment, a HNH-like domain differs from a sequence of SEQ ID NO: 16 by at least one but no more than, 2, 3, 4, or 5 residues.

In an embodiment, the HNH-like domain is cleavage competent.

In an embodiment, the HNH-like domain is cleavage incompetent.

In an embodiment, an eaCas9 molecule or eaCas9 polypeptide comprises an HNH-like domain comprising an amino acid sequence of formula VII:

```
                                              (SEQ ID NO: 18)
X1-X2-X3-H-X4-X5-P-X6-S-X8-X9-X10-D-D-S-X14-X15-N-
K-V-L-X19-X20-X21-X22-X23-N,
``` wherein
X1 is selected from D and E;
X2 is selected from L, I, R, Q, V, M and K;
X3 is selected from D and E;
X4 is selected from I, V, T, A and L (e.g., A, I and V);
X5 is selected from V, Y, I, L, F and W (e.g., V, I and L);
X6 is selected from Q, H, R, K, Y, I, L, F and W;
X8 is selected from F, L, V, K, Y, M, I, R, A, E, D and Q (e.g., F);
X9 is selected from L, R, T, I, V, S, C, Y, K, F and G;
X10 is selected from K, Q, Y, T, F, L, W, M, A, E, G, and S;
X14 is selected from I, L, F, S, R, Y, Q, W, D, K and H (e.g., I, L and F);
X15 is selected from D, S, I, N, E, A, H, F, L, Q, M, G, Y and V;
X19 is selected from T, V, C, E, S and A (e.g., T and V);
X20 is selected from R, F, T, W, E, L, N, C, K, V, S, Q, I, Y, H and A;
X21 is selected from S, P, R, K, N, A, H, Q, G and L;
X22 is selected from D, G, T, N, S, K, A, I, E, L, Q, R and Y; and
X23 is selected from K, V, A, E, Y, I, C, L, S, T, G, K, M, D and F.

In an embodiment, the HNH-like domain differs from a sequence of SEQ ID NO: 15 by 1, 2, 3, 4, or 5 residues.

In an embodiment, an eaCas9 molecule or eaCas9 polypeptide comprises an HNH-like domain comprising an amino acid sequence of formula VII:

(SEQ ID NO: 19)
X1-V-X3-H-I-V-P-X6-S-X8-X9-X10-D-D-S-X14-X15-N-K-

V-L-T-X20-X21-X22-X23-N, wherein
X1 is selected from D and E;
X3 is selected from D and E;
X6 is selected from Q, H, R, K, Y, I, L and W;
X8 is selected from F, L, V, K, Y, M, I, R, A, E, D and Q (e.g., F);
X9 is selected from L, R, T, I, V, S, C, Y, K, F and G;
X10 is selected from K, Q, Y, T, F, L, W, M, A, E, G. and S;
X14 is selected from I, L, F, S, R, Y, Q, W, D, K and H (e.g., I, L and F);
X15 is selected from D, S, I, N, E, A, H, F, L, Q, M, G, Y and V;
X20 is selected from R, F, T, W, E, L, N, C, K, V, S, Q, I, Y, H and A;
X21 is selected from S, P, R, K, N, A, H, Q, G and L;
X22 is selected from D, G, T, N, S, K, A, I, E, L, Q, R and Y; and
X23 is selected from K, V, A, E, Y, I, C, L, S, T, G, K, M, D and F.

In an embodiment, the HNH-like domain differs from a sequence of SEQ ID NO: GG by 1, 2, 3, 4, or 5 residues.

In an embodiment, an eaCas9 molecule or eaCas9 polypeptide comprises an HNH-like domain having an amino acid sequence of formula VIII:

(SEQ ID NO: 20)
D-X2-D-H-I-X5-P-Q-X7-F-X9-X10-D-X12-S-I-D-N-X16-V-

L-X19-X20-S-X22-X23-N, wherein
X2 is selected from I and V;
X5 is selected from I and V;
X7 is selected from A and S;
X9 is selected from I and L;
X10 is selected from K and T;
X12 is selected from D and N;
X16 is selected from R, K and L; X19 is selected from T and V;
X20 is selected from S and R;
X22 is selected from K, D and A; and
X23 is selected from E, K, G and N (e.g., the eaCas9 molecule or eaCas9 polypeptide can comprise an HNH-like domain as described herein).

In an embodiment, the HNH-like domain differs from a sequence of SEQ ID NO: 19 by as many as 1 but no more than 2, 3, 4, or 5 residues.

In an embodiment, an eaCas9 molecule or eaCas9 polypeptide comprises the amino acid sequence of formula IX:

(SEQ ID NO: 21)
L-Y-Y-L-Q-N-G-X1'-D-M-Y-X2'-X3'-X4'-X5'-L-D-I-X6'-

X7'-L-S-X8'-Y-Z-N-R-X9'-K-X10'-D-X11'-V-P, wherein
X1' is selected from K and R;
X2' is selected from V and T;
X3' is selected from G and D;
X4' is selected from E, Q and D;
X5' is selected from E and D;
X6' is selected from D, N and H;
X7' is selected from Y, R and N;
X8' is selected from Q, D and N; X9' is selected from G and E;
X10' is selected from S and G;
X11' is selected from D and N; and
Z is an HNH-like domain, e.g., as described above.

In an embodiment, the eaCas9 molecule or eaCas9 polypeptide comprises an amino acid sequence that differs from a sequence of SEQ ID NO: 21 by as many as 1 but no more than 2, 3, 4, or 5 residues.

In an embodiment, the HNH-like domain differs from a sequence of an HNH-like domain disclosed herein, e.g., in FIGS. 5A-5C or FIGS. 7A-7B, as many as 1 but no more than 2, 3, 4, or 5 residues. In an embodiment, 1 or both of the highly conserved residues identified in FIGS. 5A-5C or FIGS. 7A-7B are present.

In an embodiment, the HNH-like domain differs from a sequence of an HNH-like domain disclosed herein, e.g., in FIGS. 6A-6B or FIGS. 7A-7B, as many as 1 but no more than 2, 3, 4, or 5 residues. In an embodiment, 1, 2, all 3 of the highly conserved residues identified in FIGS. 6A-6B or FIGS. 7A-7B are present.

Cas9 Activities
Nuclease and Helicase Activities

In an embodiment, the Cas9 molecule or Cas9 polypeptide is capable of cleaving a target nucleic acid molecule. Typically wild type Cas9 molecules cleave both strands of a target nucleic acid molecule. Cas9 molecules and Cas9 polypeptides can be engineered to alter nuclease cleavage (or other properties), e.g., to provide a Cas9 molecule or Cas9 polypeptide which is a nickase, or which lacks the ability to cleave target nucleic acid. A Cas9 molecule or Cas9 polypeptide that is capable of cleaving a target nucleic acid molecule is referred to herein as an eaCas9 molecule or eaCas9 polypeptide.

In an embodiment, an eaCas9 molecule or eaCas9 polypeptide comprises one or more of the following activities:
  a nickase activity, i.e., the ability to cleave a single strand, e.g., the non-complementary strand or the complementary strand, of a nucleic acid molecule;
  a double stranded nuclease activity, i.e., the ability to cleave both strands of a double stranded nucleic acid and create a double stranded break, which in an embodiment is the presence of two nickase activities;
  an endonuclease activity;
  an exonuclease activity; and
  a helicase activity, i.e., the ability to unwind the helical structure of a double stranded nucleic acid.

In an embodiment, an enzymatically active or eaCas9 molecule or eaCas9 polypeptide cleaves both strands and results in a double stranded break. In an embodiment, an eaCas9 molecule cleaves only one strand, e.g., the strand to which the gRNA hybridizes to, or the strand complementary to the strand the gRNA hybridizes with. In an embodiment, an eaCas9 molecule or eaCas9 polypeptide comprises cleavage activity associated with an HNH-like domain. In an embodiment, an eaCas9 molecule or eaCas9 polypeptide comprises cleavage activity associated with an N-terminal RuvC-like domain. In an embodiment, an eaCas9 molecule or eaCas9 polypeptide comprises cleavage activity associated with an HNH-like domain and cleavage activity associated with an N-terminal RuvC-like domain. In an embodiment, an eaCas9 molecule or eaCas9 polypeptide comprises an active, or cleavage competent, HNH-like domain and an inactive, or cleavage incompetent, N-terminal RuvC-like domain. In an embodiment, an eaCas9 molecule or eaCas9 polypeptide comprises an inactive, or cleavage incompetent, HNH-like domain and an active, or cleavage competent, N-terminal RuvC-like domain.

Some Cas9 molecules or Cas9 polypeptides have the ability to interact with a gRNA molecule, and in conjunction with the gRNA molecule localize to a core target domain, but are incapable of cleaving the target nucleic acid, or incapable of cleaving at efficient rates. Cas9 molecules having no, or no substantial, cleavage activity are referred to herein as an eiCas9 molecule or eiCas9 polypeptide. For example, an eiCas9 molecule or eiCas9 polypeptide can lack cleavage activity or have substantially less, e.g., less than 20, 10, 5, 1 or 0.1% of the cleavage activity of a reference Cas9 molecule or eiCas9 polypeptide, as measured by an assay described herein.

Targeting and PAMs

RNA guided nucleases, such as Cas9 molecules or Cas9 polypeptides, generally, interact with a guide RNA (gRNA) molecule and, in concert with the gRNA molecule, localize to a site which comprises a target domain and a PAM sequence.

In an embodiment, the ability of an eaCas9 molecule or eaCas9 polypeptide to interact with and cleave a target nucleic acid is PAM sequence dependent. A PAM sequence is a sequence in the target nucleic acid. In an embodiment, cleavage of the target nucleic acid occurs upstream from the PAM sequence. EaCas9 molecules from different bacterial species can recognize different sequence motifs (e.g., PAM sequences). In an embodiment, an eaCas9 molecule of *S. pyogenes* recognizes the sequence motif NGG, NAG, NGA and directs cleavage of a target nucleic acid sequence 1 to 10, e.g., 3 to 5, base pairs upstream from that sequence. See, e.g., Mali 2013. In an embodiment, an eaCas9 molecule of *S. thermophilus* recognizes the sequence motif NGGNG and NNAGAAW (W=A or T) and directs cleavage of a core target nucleic acid sequence 1 to 10, e.g., 3 to 5, base pairs upstream from these sequences. See, e.g., Horvath 2010 and Deveau 2008. In an embodiment, an eaCas9 molecule of *S. mutans* recognizes the sequence motif NGG and/or NAAR (R=A or G) and directs cleavage of a core target nucleic acid sequence 1 to 10, e.g., 3 to 5 base pairs, upstream from this sequence. See, e.g., Deveau 2008. In an embodiment, an eaCas9 molecule of *S. aureus* recognizes the sequence motif NNGRR (R=A or G) and directs cleavage of a target nucleic acid sequence 1 to 10, e.g., 3 to 5, base pairs upstream from that sequence. In an embodiment, an eaCas9 molecule of *S. aureus* recognizes the sequence motif NNGRRN (R=A or G) and directs cleavage of a target nucleic acid sequence 1 to 10, e.g., 3 to 5, base pairs upstream from that sequence. In an embodiment, an eaCas9 molecule of *S. aureus* recognizes the sequence motif NNGRRT (R=A or G) and directs cleavage of a target nucleic acid sequence 1 to 10, e.g., 3 to 5, base pairs upstream from that sequence. In an embodiment, an eaCas9 molecule of *S. aureus* recognizes the sequence motif NNGRRV (R=A or G, V=A, G or C) and directs cleavage of a target nucleic acid sequence 1 to 10, e.g., 3 to 5, base pairs upstream from that sequence. In an embodiment, an eaCas9 molecule of *Neisseria meningitidis* recognizes the sequence motif NNNNGATT or NNNGCTT and directs cleavage of a target nucleic acid sequence 1 to 10, e.g., 3 to 5, base pairs upstream from that sequence. See, e.g., Hou 2013. The ability of a Cas9 molecule to recognize a PAM sequence can be determined, e.g., using a transformation assay described in Jinek 2012. In the aforementioned embodiments, N can be any nucleotide residue, e.g., any of A, G, C or T.

As is discussed herein, Cas9 molecules can be engineered to alter the PAM specificity of the Cas9 molecule.

Exemplary naturally occurring Cas9 molecules are described in Chylinski 2013. Such Cas9 molecules include Cas9 molecules of a cluster 1 bacterial family, cluster 2 bacterial family, cluster 3 bacterial family, cluster 4 bacterial family, cluster 5 bacterial family, cluster 6 bacterial family, a cluster 7 bacterial family, a cluster 8 bacterial family, a cluster 9 bacterial family, a cluster 10 bacterial family, a cluster 11 bacterial family, a cluster 12 bacterial family, a cluster 13 bacterial family, a cluster 14 bacterial family, a cluster 15 bacterial family, a cluster 16 bacterial family, a cluster 17 bacterial family, a cluster 18 bacterial family, a cluster 19 bacterial family, a cluster 20 bacterial family, a cluster 21 bacterial family, a cluster 22 bacterial family, a cluster 23 bacterial family, a cluster 24 bacterial family, a cluster 25 bacterial family, a cluster 26 bacterial family, a cluster 27 bacterial family, a cluster 28 bacterial family, a cluster 29 bacterial family, a cluster 30 bacterial family, a cluster 31 bacterial family, a cluster 32 bacterial family, a cluster 33 bacterial family, a cluster 34 bacterial family, a cluster 35 bacterial family, a cluster 36 bacterial family, a cluster 37 bacterial family, a cluster 38 bacterial family, a cluster 39 bacterial family, a cluster 40 bacterial family, a cluster 41 bacterial family, a cluster 42 bacterial family, a cluster 43 bacterial family, a cluster 44 bacterial family, a cluster 45 bacterial family, a cluster 46 bacterial family, a cluster 47 bacterial family, a cluster 48 bacterial family, a cluster 49 bacterial family, a cluster 50 bacterial family, a cluster 51 bacterial family, a cluster 52 bacterial family, a cluster 53 bacterial family, a cluster 54 bacterial family, a cluster 55 bacterial family, a cluster 56 bacterial family, a cluster 57 bacterial family, a cluster 58 bacterial family, a cluster 59 bacterial family, a cluster 60 bacterial family, a cluster 61 bacterial family, a cluster 62 bacterial family, a cluster 63 bacterial family, a cluster 64 bacterial family, a cluster 65 bacterial family, a cluster 66 bacterial family, a cluster 67 bacterial family, a cluster 68 bacterial family, a cluster 69 bacterial family, a cluster 70 bacterial family, a cluster 71 bacterial family, a cluster 72 bacterial family, a cluster 73 bacterial family, a cluster 74 bacterial family, a cluster 75 bacterial family, a cluster 76 bacterial family, a cluster 77 bacterial family, or a cluster 78 bacterial family.

Exemplary naturally occurring Cas9 molecules include a Cas9 molecule of a cluster 1 bacterial family. Examples include a Cas9 molecule of: *S. pyogenes* (e.g., strain SF370, MGAS10270, MGAS10750, MGAS2096, MGAS315, MGAS5005, MGAS6180, MGAS9429, NZ131 and SSI-1), *S. thermophilus* (e.g., strain LMD-9), *S. pseudoporcinus* (e.g., strain SPIN 20026), *S. mutans* (e.g., strain UA159, NN2025), *S. macacae* (e.g., strain NCTC11558), *S. gallolyticus* (e.g., strain UCN34, ATCC BAA-2069), *S. equines* (e.g., strain ATCC 9812, MGCS 124), *S. dysdalactiae* (e.g., strain GGS 124), *S. bovis* (e.g., strain ATCC 700338), *S. anginosus* (e.g., strain F0211), *S. agalactiae* (e.g., strain NEM316, A909), *Listeria monocytogenes* (e.g., strain F6854), *Listeria innocua* (*L. innocua*, e.g., strain Clip11262), *Enterococcus italicus* (e.g., strain DSM 15952), or *Enterococcus faecium* (e.g., strain 1,231,408). Another exemplary Cas9 molecule is a Cas9 molecule of *Neisseria meningitidis* (Hou 2013).

In an embodiment, a Cas9 molecule or Cas9 polypeptide, e.g., an eaCas9 molecule or eaCas9 polypeptide, comprises an amino acid sequence:

having 60%, 65%, 70%, 75%, 80%, 85%, 90%, 95%, 96%, 97%, 98% or 99% homology with;

differs at no more than, 2, 5, 10, 15, 20, 30, or 40% of the amino acid residues when compared with;

differs by at least 1, 2, 5, 10 or 20 amino acids but by no more than 100, 80, 70, 60, 50, 40 or 30 amino acids from; or is identical to any Cas9 molecule sequence described herein, or a naturally occurring Cas9 molecule sequence, e.g., a Cas9 molecule from a species listed herein or described in Chylinski 2013; Hou 2013; SEQ ID NOs: 1-4. In an embodiment, the Cas9 molecule or Cas9 polypeptide comprises one or more of the following activities: a nickase activity; a double stranded cleavage activity (e.g., an endonuclease and/or exonuclease activity); a helicase activity; or the ability, together with a gRNA molecule, to home to a target nucleic acid.

In an embodiment, a Cas9 molecule or Cas9 polypeptide comprises the amino acid sequence of the consensus sequence of FIGS. 2A-2G, wherein "*" indicates any amino acid found in the corresponding position in the amino acid sequence of a Cas9 molecule of S. pyogenes, S. thermophilus, S. mutans and L. innocua, and "-" indicates any amino acid. In an embodiment, a Cas9 molecule or Cas9 polypeptide differs from the sequence of the consensus sequence disclosed in FIGS. 2A-2G by at least 1, but no more than 2, 3, 4, 5, 6, 7, 8, 9, or 10 amino acid residues. In an embodiment, a Cas9 molecule or Cas9 polypeptide comprises the amino acid sequence of SEQ ID NO: 7 of FIGS. 7A-7B, wherein "*" indicates any amino acid found in the corresponding position in the amino acid sequence of a Cas9 molecule of S. pyogenes, or N. meningitidis, "-" indicates any amino acid, and "-" indicates any amino acid or absent. In an embodiment, a Cas9 molecule or Cas9 polypeptide differs from the sequence of SEQ ID NOs: 6 or 7 disclosed in FIGS. 7A-7B by at least 1, but no more than 2, 3, 4, 5, 6, 7, 8, 9, or 10 amino acid residues.

A comparison of the sequence of a number of Cas9 molecules indicate that certain regions are conserved. These are identified below as:

region 1 (residues 1 to 180, or in the case of region 1' residues 120 to 180) region 2 (residues 360 to 480);
region 3 (residues 660 to 720);
region 4 (residues 817 to 900); and
region 5 (residues 900 to 960);

In an embodiment, a Cas9 molecule or Cas9 polypeptide comprises regions 1-5, together with sufficient additional Cas9 molecule sequence to provide a biologically active molecule, e.g., a Cas9 molecule having at least one activity described herein. In an embodiment, each of regions 1-6, independently, have, 50%, 60%, 70%, or 80% homology with the corresponding residues of a Cas9 molecule or Cas9 polypeptide described herein, e.g., a sequence from FIGS. 2A-2G or from FIGS. 7A-7B.

In an embodiment, a Cas9 molecule or Cas9 polypeptide, e.g., an eaCas9 molecule or eaCas9 polypeptide, comprises an amino acid sequence referred to as region 1:

having 50%, 60%, 70%, 80%, 85%, 90%, 95%, 96%, 97%, 98% or 99% homology with amino acids 1-180 (the numbering is according to the motif sequence in FIGS. 2A-2G; 52% of residues in the four Cas9 sequences in FIGS. 2A-2G are conserved) of the amino acid sequence of Cas9 of S. pyogenes;

differs by at least 1, 2, 5, 10 or 20 amino acids but by no more than 90, 80, 70, 60, 50, 40 or 30 amino acids from amino acids 1-180 of the amino acid sequence of Cas9 of S. pyogenes, S. thermophilus, S. mutans or L. innocua; or is identical to 1-180 of the amino acid sequence of Cas9 of S. pyogenes, S. thermophilus, S. mutans or L. innocua.

In an embodiment, a Cas9 molecule or Cas9 polypeptide, e.g., an eaCas9 molecule or eaCas9 polypeptide, comprises an amino acid sequence referred to as region 1':

having 55%, 60%, 65%, 70%, 75%, 80%, 85%, 90%, 95%, 96%, 97%, 98% or 99% homology with amino acids 120-180 (55% of residues in the four Cas9 sequences in FIGS. 2A-2G are conserved) of the amino acid sequence of Cas9 of S. pyogenes, S. thermophilus, S. mutans or L. innocua;

differs by at least 1, 2, or 5 amino acids but by no more than 35, 30, 25, 20 or 10 amino acids from amino acids 120-180 of the amino acid sequence of Cas9 of S. pyogenes, S. thermophilus, S. mutans or L. innocua; or is identical to 120-180 of the amino acid sequence of Cas9 of S. pyogenes, S. thermophilus, S. mutans or L. innocua.

In an embodiment, a Cas9 molecule or Cas9 polypeptide, e.g., an eaCas9 molecule or eaCas9 polypeptide, comprises an amino acid sequence referred to as region 2:

having 50%, 55%, 60%, 65%, 70%, 75%, 80%, 85%, 90%, 95%, 96%, 97%, 98% or 99% homology with amino acids 360-480 (52% of residues in the four Cas9 sequences in FIGS. 2A-2G are conserved) of the amino acid sequence of Cas9 of S. pyogenes, S. thermophilus, S. mutans or L. innocua;

differs by at least 1, 2, or 5 amino acids but by no more than 35, 30, 25, 20 or 10 amino acids from amino acids 360-480 of the amino acid sequence of Cas9 of S. pyogenes, S. thermophilus, S. mutans or L. innocua; or is identical to 360-480 of the amino acid sequence of Cas9 of S. pyogenes, S. thermophilus, S. mutans or L. innocua.

In an embodiment, a Cas9 molecule or Cas9 polypeptide, e.g., an eaCas9 molecule or eaCas9 polypeptide, comprises an amino acid sequence referred to as region 3:

having 55%, 60%, 65%, 70%, 75%, 80%, 85%, 90%, 95%, 96%, 97%, 98%, or 99% homology with amino acids 660-720 (56% of residues in the four Cas9 sequences in FIGS. 2A-2G are conserved) of the amino acid sequence of Cas9 of S. pyogenes, S. thermophilus, S. mutans or L. innocua;

differs by at least 1, 2, or 5 amino acids but by no more than 35, 30, 25, 20 or 10 amino acids from amino acids 660-720 of the amino acid sequence of Cas9 of S. pyogenes, S. thermophilus, S. mutans or L. innocua; or is identical to 660-720 of the amino acid sequence of Cas9 of S. pyogenes, S. thermophilus, S. mutans or L. innocua.

In an embodiment, a Cas9 molecule or Cas9 polypeptide, e.g., an eaCas9 molecule or eaCas9 polypeptide, comprises an amino acid sequence referred to as region 4:

having 50%, 55%, 60%, 65%, 70%, 75%, 80%, 85%, 90%, 95%, 96%, 97%, 98%, or 99% homology with amino acids 817-900 (55% of residues in the four Cas9 sequences in FIGS. 2A-2G are conserved) of the amino acid sequence of Cas9 of S. pyogenes, S. thermophilus, S. mutans or L. innocua;

differs by at least 1, 2, or 5 amino acids but by no more than 35, 30, 25, 20 or 10 amino acids from amino acids 817-900 of the amino acid sequence of Cas9 of S. pyogenes, S. thermophilus, S. mutans or L. innocua; or is identical to 817-900 of the amino acid sequence of Cas9 of S. pyogenes, S. thermophilus, S. mutans or L. innocua.

In an embodiment, a Cas9 molecule or Cas9 polypeptide, e.g., an eaCas9 molecule or eaCas9 polypeptide, comprises an amino acid sequence referred to as region 5:

having 50%, 55%, 60%, 65%, 70%, 75%, 80%, 85%, 90%, 95%, 96%, 97%, 98%, or 99% homology with amino acids 900-960 (60% of residues in the four Cas9 sequences in FIGS. 2A-2G are conserved) of the amino acid sequence of Cas9 of *S. pyogenes, S. thermophilus, S. mutans* or *L. innocua;* differs by at least 1, 2, or 5 amino acids but by no more than 35, 30, 25, 20 or 10 amino acids from amino acids 900-960 of the amino acid sequence of Cas9 of *S. pyogenes, S. thermophilus, S. mutans* or *L. innocua;* or is identical to 900-960 of the amino acid sequence of Cas9 of *S. pyogenes, S. thermophilus, S. mutans* or *L. innocua.*

Modifications of RNA-Guided Nucleases

The RNA-guided nucleases described above have activities and properties that are useful in a variety of applications, but the skilled artisan will appreciate that RNA-guided nucleases may also be modified in certain instances, to alter cleavage activity, PAM specificity, or other structural or functional features.

Turning first to modifications that alter cleavage activity, mutations that reduce or eliminate the activity of domains within the NUC lobe have been described above. As discussed in more detail below, exemplary mutations that may be made in the RuvC domains, in the Cas9 HNH domain, or in the Cpf1 Nuc domain are described in Ran and Yamano, as well as in Cotta-Ramusino. In general, mutations that reduce or eliminate activity in one of the two nuclease domains result in RNA-guided nucleases with nickase activity, but it should be noted that the type of nickase activity varies depending on which domain is inactivated. As one example, inactivation of a RuvC domain of a Cas9 will result in a nickase that cleaves the complementary strand, while inactivation of a Cas9 HNH domain results in a nickase that cleaves the non-complementary strand.

Modifications of PAM specificity relative to naturally occurring Cas9 reference molecules has been described for both *S. pyogenes* (Kleinstiver 2015a) and *S. aureus* (Kleinstiver 2015b). Modifications that improve the targeting fidelity of Cas9 have also been described (Kleinstiver 2016). Each of these references is incorporated by reference herein.

RNA-guided nucleases have been split into two or more parts (see, e.g., Zetsche 2015; Fine 2015; both incorporated by reference).

RNA-guided nucleases are, in some cases, size-optimized or truncated, for example via one or more deletions that reduce the size of the nuclease while still retaining gRNA association, target and PAM recognition, and cleavage activities. In certain embodiments, RNA guided nucleases are bound, covalently or non-covalently, to another polypeptide, nucleotide, or other structure, optionally by means of a linker. RNA-guided nucleases also optionally include a tag, such as a nuclear localization signal to facilitate movement of RNA-guided nuclease protein into the nucleus.

Engineered or Altered Cas9 Molecules and Cas9 Polypeptides

Cas9 molecules and Cas9 polypeptides described herein, e.g., naturally occurring Cas9 molecules, can possess any of a number of properties, including: nickase activity, nuclease activity (e.g., endonuclease and/or exonuclease activity); helicase activity; the ability to associate functionally with a gRNA molecule; and the ability to target (or localize to) a site on a nucleic acid (e.g., PAM recognition and specificity). In an embodiment, a Cas9 molecule or Cas9 polypeptide can include all or a subset of these properties. In typical embodiments, a Cas9 molecule or Cas9 polypeptide has the ability to interact with a gRNA molecule and, in concert with the gRNA molecule, localize to a site in a nucleic acid. Other activities, e.g., PAM specificity, cleavage activity, or helicase activity can vary more widely in Cas9 molecules and Cas9 polypeptides.

Cas9 molecules include engineered Cas9 molecules and engineered Cas9 polypeptides (engineered, as used in this context, means merely that the Cas9 molecule or Cas9 polypeptide differs from a reference sequences, and implies no process or origin limitation). An engineered Cas9 molecule or Cas9 polypeptide can comprise altered enzymatic properties, e.g., altered nuclease activity, (as compared with a naturally occurring or other reference Cas9 molecule) or altered helicase activity. As discussed herein, an engineered Cas9 molecule or Cas9 polypeptide can have nickase activity (as opposed to double strand nuclease activity). In an embodiment an engineered Cas9 molecule or Cas9 polypeptide can have an alteration that alters its size, e.g., a deletion of amino acid sequence that reduces its size, e.g., without significant effect on one or more, or any Cas9 activity. In an embodiment, an engineered Cas9 molecule or Cas9 polypeptide can comprise an alteration that affects PAM recognition. E.g., an engineered Cas9 molecule can be altered to recognize a PAM sequence other than that recognized by the endogenous wild-type PI domain. In an embodiment, a Cas9 molecule or Cas9 polypeptide can differ in sequence from a naturally occurring Cas9 molecule but not have significant alteration in one or more Cas9 activities.

Cas9 molecules or Cas9 polypeptides with desired properties can be made in a number of ways, e.g., by alteration of a parental, e.g., naturally occurring, Cas9 molecules or Cas9 polypeptides, to provide an altered Cas9 molecule or Cas9 polypeptide having a desired property. For example, one or more mutations or differences relative to a parental Cas9 molecule, e.g., a naturally occurring or engineered Cas9 molecule, can be introduced. Such mutations and differences comprise: substitutions (e.g., conservative substitutions or substitutions of non-essential amino acids); insertions; or deletions. In an embodiment, a Cas9 molecule or Cas9 polypeptide can comprises one or more mutations or differences, e.g., at least 1, 2, 3, 4, 5, 10, 15, 20, 30, 40 or 50 mutations, but less than 200, 100, or 80 mutations relative to a reference, e.g., a parental, Cas9 molecule.

In an embodiment, a mutation or mutations do not have a substantial effect on a Cas9 activity, e.g. a Cas9 activity described herein. In an embodiment, a mutation or mutations have a substantial effect on a Cas9 activity, e.g. a Cas9 activity described herein.

Non-Cleaving and Modified-Cleavage Cas9 Molecules and Cas9 Polypeptides

In an embodiment, a Cas9 molecule or Cas9 polypeptide comprises a cleavage property that differs from naturally occurring Cas9 molecules, e.g., that differs from the naturally occurring Cas9 molecule having the closest homology. For example, a Cas9 molecule or Cas9 polypeptide can differ from naturally occurring Cas9 molecules, e.g., a Cas9 molecule of *S. pyogenes*, as follows: its ability to modulate, e.g., decreased or increased, cleavage of a double stranded nucleic acid (endonuclease and/or exonuclease activity), e.g., as compared to a naturally occurring Cas9 molecule (e.g., a Cas9 molecule of *S. pyogenes*); its ability to modulate, e.g., decreased or increased, cleavage of a single strand of a nucleic acid, e.g., a non-complementary strand of a nucleic acid molecule or a complementary strand of a nucleic acid molecule (nickase activity), e.g., as compared to a naturally occurring Cas9 molecule (e.g., a Cas9 molecule of *S. pyogenes*); or the ability to cleave a nucleic acid molecule, e.g., a double stranded or single stranded nucleic acid molecule, can be eliminated.

Modified Cleavage eaCas9 Molecules and eaCas9 Polypeptides

In an embodiment, an eaCas9 molecule or eaCas9 polypeptide comprises one or more of the following activities: cleavage activity associated with an N-terminal RuvC-like domain; cleavage activity associated with an HNH-like domain; cleavage activity associated with an HNH-like domain and cleavage activity associated with an N-terminal RuvC-like domain.

In an embodiment, an eaCas9 molecule or eaCas9 polypeptide comprises an active, or cleavage competent, HNH-like domain (e.g., an HNH-like domain described herein, e.g., SEQ ID NO: 17, SEQ ID NO: 18, SEQ ID NO: 19, SEQ ID NO: 20, or SEQ ID NO: 21) and an inactive, or cleavage incompetent, N-terminal RuvC-like domain. An exemplary inactive, or cleavage incompetent N-terminal RuvC-like domain can have a mutation of an aspartic acid in an N-terminal RuvC-like domain, e.g., an aspartic acid at position 9 of the consensus sequence disclosed in FIGS. 2A-2G or an aspartic acid at position 10 of SEQ ID NO: 7, e.g., can be substituted with an alanine. In an embodiment, the eaCas9 molecule or eaCas9 polypeptide differs from wild type in the N-terminal RuvC-like domain and does not cleave the target nucleic acid, or cleaves with significantly less efficiency, e.g., less than 20, 10, 5, 1 or 0.1% of the cleavage activity of a reference Cas9 molecule, e.g., as measured by an assay described herein. The reference Cas9 molecule can by a naturally occurring unmodified Cas9 molecule, e.g., a naturally occurring Cas9 molecule such as a Cas9 molecule of *S. pyogenes*, or *S. thermophilus*. In an embodiment, the reference Cas9 molecule is the naturally occurring Cas9 molecule having the closest sequence identity or homology.

In an embodiment, an eaCas9 molecule or eaCas9 polypeptide comprises an inactive, or cleavage incompetent, HNH domain and an active, or cleavage competent, N-terminal RuvC-like domain (e.g., an N-terminal RuvC-like domain described herein, e.g., SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, or SEQ ID NO: 16). Exemplary inactive, or cleavage incompetent HNH-like domains can have a mutation at one or more of: a histidine in an HNH-like domain, e.g., a histidine shown at position 856 of FIGS. 2A-2G, e.g., can be substituted with an alanine; and one or more asparagines in an HNH-like domain, e.g., an asparagine shown at position 870 of FIGS. 2A-2G and/or at position 879 of FIGS. 2A-2G, e.g., can be substituted with an alanine. In an embodiment, the eaCas9 differs from wild type in the HNH-like domain and does not cleave the target nucleic acid, or cleaves with significantly less efficiency, e.g., less than 20, 10, 5, 1 or 0.1% of the cleavage activity of a reference Cas9 molecule, e.g., as measured by an assay described herein. The reference Cas9 molecule can by a naturally occurring unmodified Cas9 molecule, e.g., a naturally occurring Cas9 molecule such as a Cas9 molecule of *S. pyogenes*, or *S. thermophilus*. In an embodiment, the reference Cas9 molecule is the naturally occurring Cas9 molecule having the closest sequence identity or homology.

Alterations in the Ability to Cleave One or Both Strands of a Target Nucleic Acid In an embodiment, exemplary Cas9 activities comprise one or more of PAM specificity, cleavage activity, and helicase activity. A mutation(s) can be present, e.g., in one or more RuvC-like domain, e.g., an N-terminal RuvC-like domain; an HNH-like domain; a region outside the RuvC-like domains and the HNH-like domain. In some embodiments, a mutation(s) is present in a RuvC-like domain, e.g., an N-terminal RuvC-like domain. In some embodiments, a mutation(s) is present in an HNH-like domain. In some embodiments, mutations are present in both a RuvC-like domain, e.g., an N-terminal RuvC-like domain, and an HNH-like domain.

Exemplary mutations that may be made in the RuvC domain or HNH domain with reference to the *S. pyogenes* sequence include: D10A, E762A, H840A, N854A, N863A and/or D986A.

In an embodiment, a Cas9 molecule or Cas9 polypeptide is an eiCas9 molecule or eiCas9 polypeptide comprising one or more differences in a RuvC domain and/or in an HNH domain as compared to a reference Cas9 molecule, and the eiCas9 molecule or eiCas9 polypeptide does not cleave a nucleic acid, or cleaves with significantly less efficiency than does wildtype, e.g., when compared with wild type in a cleavage assay, e.g., as described herein, cuts with less than 50, 25, 10, or 1% of a reference Cas9 molecule, as measured by an assay described herein.

Whether or not a particular sequence, e.g., a substitution, may affect one or more activity, such as targeting activity, cleavage activity, etc., can be evaluated or predicted, e.g., by evaluating whether the mutation is conservative or by the method described in Section V. In an embodiment, a "non-essential" amino acid residue, as used in the context of a Cas9 molecule, is a residue that can be altered from the wild-type sequence of a Cas9 molecule, e.g., a naturally occurring Cas9 molecule, e.g., an eaCas9 molecule, without abolishing or more preferably, without substantially altering a Cas9 activity (e.g., cleavage activity), whereas changing an "essential" amino acid residue results in a substantial loss of activity (e.g., cleavage activity).

In an embodiment, a Cas9 molecule or Cas9 polypeptide comprises a cleavage property that differs from naturally occurring Cas9 molecules, e.g., that differs from the naturally occurring Cas9 molecule having the closest homology. For example, a Cas9 molecule or Cas9 polypeptide can differ from naturally occurring Cas9 molecules, e.g., a Cas9 molecule of *S aureus*, *S. pyogenes*, or *C. jejuni* as follows: its ability to modulate, e.g., decreased or increased, cleavage of a double stranded break (endonuclease and/or exonuclease activity), e.g., as compared to a naturally occurring Cas9 molecule (e.g., a Cas9 molecule of *S aureus*, *S. pyogenes*, or *C. jejuni*); its ability to modulate, e.g., decreased or increased, cleavage of a single strand of a nucleic acid, e.g., a non-complimentary strand of a nucleic acid molecule or a complementary strand of a nucleic acid molecule (nickase activity), e.g., as compared to a naturally occurring Cas9 molecule (e.g., a Cas9 molecule of *S aureus*, *S. pyogenes*, or *C. jejuni*); or the ability to cleave a nucleic acid molecule, e.g., a double stranded or single stranded nucleic acid molecule, can be eliminated.

In an embodiment, the altered Cas9 molecule or Cas9 polypeptide is an eaCas9 molecule or eaCas9 polypeptide comprising one or more of the following activities: cleavage activity associated with a RuvC domain; cleavage activity associated with an HNH domain; cleavage activity associated with an HNH domain and cleavage activity associated with a RuvC domain.

In an embodiment, the altered Cas9 molecule or Cas9 polypeptide is an eiCas9 molecule or eiCas9 polypeptide which does not cleave a nucleic acid molecule (either double stranded or single stranded nucleic acid molecules) or cleaves a nucleic acid molecule with significantly less efficiency, e.g., less than 20, 10, 5, 1 or 0.1% of the cleavage activity of a reference Cas9 molecule, e.g., as measured by an assay described herein. The reference Cas9 molecule can be a naturally occurring unmodified Cas9 molecule, e.g., a naturally occurring Cas9 molecule such as a Cas9 molecule of S. pyogenes, S. thermophilus, S. aureus, C. jejuni or N. meningitidis. In an embodiment, the reference Cas9 molecule is the naturally occurring Cas9 molecule having the closest sequence identity or homology. In an embodiment, the eiCas9 molecule or eiCas9 polypeptide lacks substantial cleavage activity associated with a RuvC domain and cleavage activity associated with an HNH domain.

In an embodiment, the altered Cas9 molecule or Cas9 polypeptide is an eaCas9 molecule or eaCas9 polypeptide comprising the fixed amino acid residues of S. pyogenes shown in the consensus sequence disclosed in FIGS. 2A-2G, and has one or more amino acids that differ from the amino acid sequence of S. pyogenes (e.g., has a substitution) at one or more residue (e.g., 2, 3, 5, 10, 15, 20, 30, 50, 70, 80, 90, 100, 200 amino acid residues) represented by an "-" in the consensus sequence disclosed in FIG. 2A-2G or SEQ ID NO: 7.

In an embodiment, the altered Cas9 molecule or Cas9 polypeptide comprises a sequence in which:

the sequence corresponding to the fixed sequence of the consensus sequence disclosed in FIGS. 2A-2G differs at no more than 1, 2, 3, 4, 5, 10, 15, or 20% of the fixed residues in the consensus sequence disclosed in FIGS. 2A-2G;

the sequence corresponding to the residues identified by "*" in the consensus sequence disclosed in FIGS. 2A-2G differ at no more than 1, 2, 3, 4, 5, 10, 15, 20, 25, 30, 35, or 40% of the "*" residues from the corresponding sequence of naturally occurring Cas9 molecule, e.g., an S. pyogenes Cas9 molecule; and, the sequence corresponding to the residues identified by "-" in the consensus sequence disclosed in FIGS. 2A-2G differ at no more than 5, 10, 15, 20, 25, 30, 35, 40, 45, 55, or 60% of the "-" residues from the corresponding sequence of naturally occurring Cas9 molecule, e.g., an S. pyogenes Cas9 molecule.

In an embodiment, the altered Cas9 molecule or Cas9 polypeptide is an eaCas9 molecule or eaCas9 polypeptide comprising the fixed amino acid residues of S. thermophilus shown in the consensus sequence disclosed in FIGS. 2A-2G, and has one or more amino acids that differ from the amino acid sequence of S. thermophilus (e.g., has a substitution) at one or more residue (e.g., 2, 3, 5, 10, 15, 20, 30, 50, 70, 80, 90, 100, 200 amino acid residues) represented by an "-" in the consensus sequence disclosed in FIGS. 2A-2G.

In an embodiment the altered Cas9 molecule or Cas9 polypeptide comprises a sequence in which:

the sequence corresponding to the fixed sequence of the consensus sequence disclosed in FIGS. 2A-2G differs at no more than 1, 2, 3, 4, 5, 10, 15, or 20% of the fixed residues in the consensus sequence disclosed in FIGS. 2A-2G;

the sequence corresponding to the residues identified by "*" in the consensus sequence disclosed in FIGS. 2A-2G differ at no more than 1, 2, 3, 4, 5, 10, 15, 20, 25, 30, 35, or 40% of the "*" residues from the corresponding sequence of naturally occurring Cas9 molecule, e.g., an S. thermophilus Cas9 molecule; and, the sequence corresponding to the residues identified by "-" in the consensus sequence disclosed in FIGS. 2A-2G differ at no more than 5, 10, 15, 20, 25, 30, 35, 40, 45, 55, or 60% of the "-" residues from the corresponding sequence of naturally occurring Cas9 molecule, e.g., an S. thermophilus Cas9 molecule.

In an embodiment, the altered Cas9 molecule or Cas9 polypeptide is an eaCas9 molecule or eaCas9 polypeptide comprising the fixed amino acid residues of S. mutans shown in the consensus sequence disclosed in FIGS. 2A-2G, and has one or more amino acids that differ from the amino acid sequence of S. mutans (e.g., has a substitution) at one or more residue (e.g., 2, 3, 5, 10, 15, 20, 30, 50, 70, 80, 90, 100, 200 amino acid residues) represented by an "-" in the consensus sequence disclosed in FIGS. 2A-2G.

In an embodiment, the altered Cas9 molecule or Cas9 polypeptide comprises a sequence in which:

the sequence corresponding to the fixed sequence of the consensus sequence disclosed in FIGS. 2A-2G differs at no more than 1, 2, 3, 4, 5, 10, 15, or 20% of the fixed residues in the consensus sequence disclosed in FIGS. 2A-2G;

the sequence corresponding to the residues identified by "*" in the consensus sequence disclosed in FIGS. 2A-2G differ at no more than 1, 2, 3, 4, 5, 10, 15, 20, 25, 30, 35, or 40% of the "*" residues from the corresponding sequence of naturally occurring Cas9 molecule, e.g., an S. mutans Cas9 molecule; and, the sequence corresponding to the residues identified by "-" in the consensus sequence disclosed in FIGS. 2A-2G differ at no more than 5, 10, 15, 20, 25, 30, 35, 40, 45, 55, or 60% of the "-" residues from the corresponding sequence of naturally occurring Cas9 molecule, e.g., an S. mutans Cas9 molecule.

In an embodiment, the altered Cas9 molecule or Cas9 polypeptide is an eaCas9 molecule or eaCas9 polypeptide comprising the fixed amino acid residues of L. innocula shown in the consensus sequence disclosed in FIGS. 2A-2G, and has one or more amino acids that differ from the amino acid sequence of L. innocula (e.g., has a substitution) at one or more residue (e.g., 2, 3, 5, 10, 15, 20, 30, 50, 70, 80, 90, 100, 200 amino acid residues) represented by an "-" in the consensus sequence disclosed in FIGS. 2A-2G.

In an embodiment, the altered Cas9 molecule or Cas9 polypeptide comprises a sequence in which:

the sequence corresponding to the fixed sequence of the consensus sequence disclosed in FIGS. 2A-2G differs at no more than 1, 2, 3, 4, 5, 10, 15, or 20% of the fixed residues in the consensus sequence disclosed in FIGS. 2A-2G;

the sequence corresponding to the residues identified by "*" in the consensus sequence disclosed in FIGS. 2A-2G differ at no more than 1, 2, 3, 4, 5, 10, 15, 20, 25, 30, 35, or 40% of the "*" residues from the corresponding sequence of naturally occurring Cas9 molecule, e.g., an L. innocula Cas9 molecule; and, the sequence corresponding to the residues identified by "-" in the consensus sequence disclosed in FIGS. 2A-2G differ at no more than 5, 10, 15, 20, 25, 30, 35, 40, 45, 55, or 60% of the "-" residues from the corresponding sequence of naturally occurring Cas9 molecule, e.g., an L. innocula Cas9 molecule.

In an embodiment, the altered Cas9 molecule or Cas9 polypeptide, e.g., an eaCas9 molecule, can be a fusion, e.g., of two of more different Cas9 molecules or Cas9 polypeptides, e.g., of two or more naturally occurring Cas9 molecules of different species. For example, a fragment of a naturally occurring Cas9 molecule of one species can be fused to a fragment of a Cas9 molecule of a second species. As an example, a fragment of Cas9 molecule of S. pyogenes comprising an N-terminal RuvC-like domain can be fused to a fragment of Cas9 molecule of a species other than *S. pyogenes* (e.g., *S. thermophilus*) comprising an HNH-like domain.

Cas9 Molecules and Cas9 Polypeptides with Altered PAM Recognition or No PAM Recognition Naturally occurring Cas9 molecules can recognize specific PAM sequences, for example, the PAM recognition sequences described above for *S. pyogenes, S. thermophilus, S. mutans, S. aureus* and *N. meningitidis*.

In an embodiment, a Cas9 molecule or Cas9 polypeptide has the same PAM specificities as a naturally occurring Cas9 molecule. In other embodiments, a Cas9 molecule or Cas9 polypeptide has a PAM specificity not associated with a naturally occurring Cas9 molecule, or a PAM specificity not associated with the naturally occurring Cas9 molecule to which it has the closest sequence homology. For example, a naturally occurring Cas9 molecule can be altered, e.g., to alter PAM recognition, e.g., to alter the PAM sequence that the Cas9 molecule recognizes to decrease off target sites and/or improve specificity; or eliminate a PAM recognition requirement. In an embodiment, a Cas9 molecule or Cas9 polypeptide can be altered, e.g., to increase length of PAM recognition sequence and/or improve Cas9 specificity to high level of identity, e.g., to decrease off target sites and increase specificity. In an embodiment, the length of the PAM recognition sequence is at least 4, 5, 6, 7, 8, 9, 10 or 15 amino acids in length. Cas9 molecules or Cas9 polypeptides that recognize different PAM sequences and/or have reduced off-target activity can be generated using directed evolution. Exemplary methods and systems that can be used for directed evolution of Cas9 molecules are described, e.g., in Esvelt 2011. Candidate Cas9 molecules can be evaluated, e.g., by methods described in Section V.

Alterations of the PI domain, which mediates PAM recognition, are discussed below.

Synthetic Cas9 Molecules and Cas9 Polypeptides with Altered PI Domains

Current genome-editing methods are limited in the diversity of target sequences that can be targeted by the PAM sequence that is recognized by the Cas9 molecule utilized. A synthetic Cas9 molecule (or Syn-Cas9 molecule), or synthetic Cas9 polypeptide (or Syn-Cas9 polypeptide), as that term is used herein, refers to a Cas9 molecule or Cas9 polypeptide that comprises a Cas9 core domain from one bacterial species and a functional altered PI domain, i.e., a PI domain other than that naturally associated with the Cas9 core domain, e.g., from a different bacterial species.

In an embodiment, the altered PI domain recognizes a PAM sequence that is different from the PAM sequence recognized by the naturally-occurring Cas9 from which the Cas9 core domain is derived. In an embodiment, the altered PI domain recognizes the same PAM sequence recognized by the naturally-occurring Cas9 from which the Cas9 core domain is derived, but with different affinity or specificity. A Syn-Cas9 molecule or Syn-Cas9 polypeptide can be, respectively, a Syn-eaCas9 molecule or Syn-eaCas9 polypeptide or a Syn-eiCas9 molecule Syn-eiCas9 polypeptide.

An exemplary Syn-Cas9 molecule or Syn-Cas9 polypeptide comprises:

a) a Cas9 core domain, e.g., a Cas9 core domain from Table 12 or 13, e.g., a *S. aureus, S. pyogenes*, or *C. jejuni* Cas9 core domain; and b) an altered PI domain from a species X Cas9 sequence selected from Tables 15 and 16.

In an embodiment, the RKR motif (the PAM binding motif) of said altered PI domain comprises: differences at 1, 2, or 3 amino acid residues; a difference in amino acid sequence at the first, second, or third position; differences in amino acid sequence at the first and second positions, the first and third positions, or the second and third positions; as compared with the sequence of the RKR motif of the native or endogenous PI domain associated with the Cas9 core domain.

In an embodiment, the Cas9 core domain comprises the Cas9 core domain from a species X Cas9 from Table 12 and said altered PI domain comprises a PI domain from a species Y Cas9 from Table 12.

In an embodiment, the RKR motif of the species X Cas9 is other than the RKR motif of the species Y Cas9.

In an embodiment, the RKR motif of the altered PI domain is selected from XXY, XNG, and XNQ.

In an embodiment, the altered PI domain has at least 60, 70, 80, 90, 95, or 100% homology with the amino acid sequence of a naturally occurring PI domain of said species Y from Table 12.

In an embodiment, the altered PI domain differs by no more than 50, 40, 30, 25, 20, 15, 10, 5, 4, 3, 2, or 1 amino acid residue from the amino acid sequence of a naturally occurring PI domain of said second species from Table 12.

In an embodiment, the Cas9 core domain comprises a *S. aureus* core domain and altered PI domain comprises: an *A. denitrificans* PI domain; a *C. jejuni* PI domain; a *H. mustelae* PI domain; or an altered PI domain of species X PI domain, wherein species X is selected from Table 16.

In an embodiment, the Cas9 core domain comprises a *S. pyogenes* core domain and the altered PI domain comprises: an *A. denitrificans* PI domain; a *C. jejuni* PI domain; a *H. mustelae* PI domain; or an altered PI domain of species X PI domain, wherein species X is selected from Table 16.

In an embodiment, the Cas9 core domain comprises a *C. jejuni* core domain and the altered PI domain comprises: an *A. denitrificans* PI domain; a *H. mustelae* PI domain; or an altered PI domain of species X PI domain, wherein species X is selected from Table 16.

In an embodiment, the Cas9 molecule or Cas9 polypeptide further comprises a linker disposed between said Cas9 core domain and said altered PI domain.

In an embodiment, the linker comprises: a linker described elsewhere herein disposed between the Cas9 core domain and the heterologous PI domain. Suitable linkers are further described in Section VI.

Exemplary altered PI domains for use in Syn-Cas9 molecules are described in Tables 15 and 16. The sequences for the 83 Cas9 orthologs referenced in Tables 15 and 16 are provided in Table 12. Table 14 provides the Cas9 orthologs with known PAM sequences and the corresponding RKR motif.

In an embodiment, a Syn-Cas9 molecule or Syn-Cas9 polypeptide may also be size-optimized, e.g., the Syn-Cas9 molecule or Syn-Cas9 polypeptide comprises one or more deletions, and optionally one or more linkers disposed between the amino acid residues flanking the deletions. In an embodiment, a Syn-Cas9 molecule or Syn-Cas9 polypeptide comprises a REC deletion.

Size-Optimized Cas9 Molecules and Cas9 Polypeptides

Engineered Cas9 molecules and engineered Cas9 polypeptides described herein include a Cas9 molecule or Cas9 polypeptide comprising a deletion that reduces the size of the molecule while still retaining desired Cas9 properties, e.g., essentially native conformation, Cas9 nuclease activity, and/or target nucleic acid molecule recognition. Provided herein are Cas9 molecules or Cas9 polypeptides comprising one or more deletions and optionally one or more linkers, wherein a linker is disposed between the amino acid residues that flank the deletion. Methods for identifying suitable deletions in a reference Cas9 molecule, methods for generating Cas9 molecules with a deletion and a linker, and methods for using such Cas9 molecules will be apparent to one of ordinary skill in the art upon review of this document.

A Cas9 molecule, e.g., a S. aureus, S. pyogenes, or C. jejuni, Cas9 molecule, having a deletion is smaller, e.g., has reduced number of amino acids, than the corresponding naturally-occurring Cas9 molecule. The smaller size of the Cas9 molecules allows increased flexibility for delivery methods, and thereby increases utility for genome-editing. A Cas9 molecule or Cas9 polypeptide can comprise one or more deletions that do not substantially affect or decrease the activity of the resultant Cas9 molecules or Cas9 polypeptides described herein. Activities that are retained in the Cas9 molecules or Cas9 polypeptides comprising a deletion as described herein include one or more of the following:

a nickase activity, i.e., the ability to cleave a single strand, e.g., the non-complementary strand or the complementary strand, of a nucleic acid molecule; a double stranded nuclease activity, i.e., the ability to cleave both strands of a double stranded nucleic acid and create a double stranded break, which in an embodiment is the presence of two nickase activities;

an endonuclease activity;

an exonuclease activity;

a helicase activity, i.e., the ability to unwind the helical structure of a double stranded nucleic acid;

and recognition activity of a nucleic acid molecule, e.g., a target nucleic acid or a gRNA.

Activity of the Cas9 molecules or Cas9 polypeptides described herein can be assessed using the activity assays described herein or in the art.

Identifying Regions Suitable for Deletion

Suitable regions of Cas9 molecules for deletion can be identified by a variety of methods. Naturally-occurring orthologous Cas9 molecules from various bacterial species, e.g., any one of those listed in Table 12, can be modeled onto the crystal structure of S. pyogenes Cas9 (Nishimasu 2014) to examine the level of conservation across the selected Cas9 orthologs with respect to the three-dimensional conformation of the protein. Less conserved or unconserved regions that are spatially located distant from regions involved in Cas9 activity, e.g., interface with the target nucleic acid molecule and/or gRNA, represent regions or domains are candidates for deletion without substantially affecting or decreasing Cas9 activity.

REC-Optimized Cas9 Molecules and Cas9 Polypeptides

A REC-optimized Cas9 molecule, or a REC-optimized Cas9 polypeptide, as that term is used herein, refers to a Cas9 molecule or Cas9 polypeptide that comprises a deletion in one or both of the REC2 domain and the $RE1_{CT}$ domain (collectively a REC deletion), wherein the deletion comprises at least 10% of the amino acid residues in the cognate domain. A REC-optimized Cas9 molecule or Cas9 polypeptide can be an eaCas9 molecule or eaCas9 polypeptide, or an eiCas9 molecule or eiCas9 polypeptide. An exemplary REC-optimized Cas9 molecule or REC-optimized Cas9 polypeptide comprises:

a) a deletion selected from:
i) a REC2 deletion;
ii) a $REC1_{CT}$ deletion; or
iii) a $REC1_{SUB}$ deletion.

Optionally, a linker is disposed between the amino acid residues that flank the deletion. In an embodiment, a Cas9 molecule or Cas9 polypeptide includes only one deletion, or only two deletions. A Cas9 molecule or Cas9 polypeptide can comprise a REC2 deletion and a $REC1_{CT}$ deletion. A Cas9 molecule or Cas9 polypeptide can comprise a REC2 deletion and a $REC1_{SUB}$ deletion.

Generally, the deletion will contain at least 10% of the amino acids in the cognate domain, e.g., a REC2 deletion will include at least 10% of the amino acids in the REC2 domain.

A deletion can comprise: at least 10, 20, 30, 40, 50, 60, 70, 80, or 90% of the amino acid residues of its cognate domain; all of the amino acid residues of its cognate domain; an amino acid residue outside its cognate domain; a plurality of amino acid residues outside its cognate domain; the amino acid residue immediately N terminal to its cognate domain; the amino acid residue immediately C terminal to its cognate domain; the amino acid residue immediately N terminal to its cognate and the amino acid residue immediately C terminal to its cognate domain; a plurality of, e.g., up to 5, 10, 15, or 20, amino acid residues N terminal to its cognate domain; a plurality of, e.g., up to 5, 10, 15, or 20, amino acid residues C terminal to its cognate domain; a plurality of, e.g., up to 5, 10, 15, or 20, amino acid residues N terminal to its cognate domain and a plurality of e.g., up to 5, 10, 15, or 20, amino acid residues C terminal to its cognate domain.

In an embodiment, a deletion does not extend beyond: its cognate domain; the N terminal amino acid residue of its cognate domain; the C terminal amino acid residue of its cognate domain.

A REC-optimized Cas9 molecule or REC-optimized Cas9 polypeptide can include a linker disposed between the amino acid residues that flank the deletion. Suitable linkers for use between the amino acid resides that flank a REC deletion in a REC-optimized Cas9 molecule or REC-optimized Cas9 polypeptide is disclosed in Section VI.

In an embodiment, a REC-optimized Cas9 molecule or REC-optimized Cas9 polypeptide comprises an amino acid sequence that, other than any REC deletion and associated linker, has at least 50, 55, 60, 65, 70, 75, 80, 85, 90, 95, 99, or 100% homology with the amino acid sequence of a naturally occurring Cas 9, e.g., a Cas9 molecule described in Table 12, e.g., a S. aureus Cas9 molecule, a S. pyogenes Cas9 molecule, or a C. jejuni Cas9 molecule.

In an embodiment, a REC-optimized Cas9 molecule or REC-optimized Cas9 polypeptide comprises an amino acid sequence that, other than any REC deletion and associated linker, differs by no more than 1, 2, 3, 4, 5, 6, 7, 8, 9, 10, 15, 20, or 25, amino acid residues from the amino acid sequence of a naturally occurring Cas 9, e.g., a Cas9 molecule described in Table 12, e.g., a S. aureus Cas9 molecule, a S. pyogenes Cas9 molecule, or a C. jejuni Cas9 molecule.

In an embodiment, a REC-optimized Cas9 molecule or REC-optimized Cas9 polypeptide comprises an amino acid sequence that, other than any REC deletion and associate linker, differs by no more than 1, 2, 3, 4, 5, 6, 7, 8, 9, 10, 15, 20, or 25% of the, amino acid residues from the amino acid sequence of a naturally occurring Cas 9, e.g., a Cas9 molecule described in Table 12, e.g., a S. aureus Cas9 molecule, a S. pyogenes Cas9 molecule, or a C. jejuni Cas9 molecule.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters. Methods of alignment of sequences for comparison are well known in the art. Optimal alignment of sequences for comparison can be conducted, e.g., by the local homology algorithm of Smith & Waterman 1981, by the homology alignment algorithm of Needleman & Wunsch 1970, by the search for similarity method of Pearson & Lipman 1988, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., Brent et al., Current Protocols in Molecular Biology, John Wiley & Sons, Inc. (2003)).

Two examples of algorithms that are suitable for determining percent sequence identity and sequence similarity are the BLAST and BLAST 2.0 algorithms, which are described in Altschul 1977 and Altschul 1990), respectively. Software for performing BLAST analyses is publicly available through the National Center for Biotechnology Information.

The percent identity between two amino acid sequences can also be determined using the algorithm of Myers 1988, which has been incorporated into the ALIGN program (version 2.0), using a PAM120 weight residue table, a gap length penalty of 12 and a gap penalty of 4. In addition, the percent identity between two amino acid sequences can be determined using the Needleman & Wunsch 1970 algorithm, which has been incorporated into the GAP program in the GCG software package (available at www.gcg.com), using either a Blossom 62 matrix or a PAM250 matrix, and a gap weight of 16, 14, 12, 10, 8, 6, or 4 and a length weight of 1, 2, 3, 4, 5, or 6.

Sequence information for exemplary REC deletions are provided for 83 naturally-occurring Cas9 orthologs in Table 12. The amino acid sequences of exemplary Cas9 molecules from different bacterial species are shown below.

TABLE 12

Amino Acid Sequence of Cas9 Orthologs

| Species/ Composite ID | Amino acid sequence | REC2 | | | REC1$_{CT}$ | | | Rec$_{sub}$ | | |
|---|---|---|---|---|---|---|---|---|---|---|
| | | start (AA pos) | stop (AA pos) | # AA deleted | start (AA pos) | stop (AA pos) | # AA deleted | start (AA pos) | stop (AA pos) | # AA deleted |
| Staphylococcus aureus tr\|J7RUA5\|J7RUA5_STAAU | SEQ ID NO: 26 | 126 | 166 | 41 | 296 | 352 | 57 | 296 | 352 | 57 |
| Streptococcus pyogenes sp\|Q99ZW2\|CAS9_STRP1 | SEQ ID NO: 2 | 176 | 314 | 139 | 511 | 592 | 82 | 511 | 592 | 82 |
| Campylobacter jejuni NCTC 11168 gi\|218563121\|ref\| YP_002344900.1 | SEQ ID NO: 306 | 137 | 181 | 45 | 316 | 360 | 45 | 316 | 360 | 45 |
| Bacteroides fragilis NCTC 9343 gi\|60683389\|ref\| YP_213533.1\| | SEQ ID NO: 307 | 148 | 339 | 192 | 524 | 617 | 84 | 524 | 617 | 84 |
| Bifidobacterium bifidum S17 gi\|310286728\|ref\| YP_003937986. | SEQ ID NO: 308 | 173 | 335 | 163 | 516 | 607 | 87 | 516 | 607 | 87 |
| Veillonella atypica ACS-134-V-Col7a gi\|303229466\|ref\| ZP_07316256.1 | SEQ ID NO: 309 | 185 | 339 | 155 | 574 | 663 | 79 | 574 | 663 | 79 |
| Lactobacillus rhamnosus GG gi\|258509199\|ref\| YP_003171950.1 | SEQ ID NO: 310 | 169 | 320 | 152 | 559 | 645 | 78 | 559 | 645 | 78 |
| Filifactor alocis ATCC 35896 gi\|374307738\|ref\| YP_005054169.1 | SEQ ID NO: 311 | 166 | 314 | 149 | 508 | 592 | 76 | 508 | 592 | 76 |
| Oenococcus kitaharae DSM 17330 gi\|366983953\|gb\| EHN59352.1\| | SEQ ID NO: 312 | 169 | 317 | 149 | 555 | 639 | 80 | 555 | 639 | 80 |
| Fructobacillus fructosus KCTC 3544 gi\|339625081\|ref\| ZP_08660870.1 | SEQ ID NO: 313 | 168 | 314 | 147 | 488 | 571 | 76 | 488 | 571 | 76 |
| Catenibacterium mitsuokai DSM 15897 gi\|224543312\|ref\| ZP_03683851.1 | SEQ ID NO: 314 | 173 | 318 | 146 | 511 | 594 | 78 | 511 | 594 | 78 |

TABLE 12-continued

Amino Acid Sequence of Cas9 Orthologs

| Species/ Composite ID | Amino acid sequence | REC2 | | | REC1$_{CT}$ | | | Rec$_{sub}$ | | |
|---|---|---|---|---|---|---|---|---|---|---|
| | | start (AA pos) | stop (AA pos) | # AA deleted | start (AA pos) | stop (AA pos) | # AA deleted | start (AA pos) | stop (AA pos) | # AA deleted |
| *Finegoldia magna* ATCC 29328 gi\|169823755\|ref\| YP_001691366.1 | SEQ ID NO: 315 | 168 | 313 | 146 | 452 | 534 | 77 | 452 | 534 | 77 |
| *Coriobacterium glomerans* PW2 gi\|328956315\|ref\| YP_004373648.1 | SEQ ID NO: 316 | 175 | 318 | 144 | 511 | 592 | 82 | 511 | 592 | 82 |
| *Eubacterium yurii* ATCC 43715 gi\|306821691\|ref\| ZP_07455288.1 | SEQ ID NO: 317 | 169 | 310 | 142 | 552 | 633 | 76 | 552 | 633 | 76 |
| *Peptoniphilus duerdenii* ATCC BAA-1640 gi\|304438954\|ref\| ZP_07398877.1 | SEQ ID NO: 318 | 171 | 311 | 141 | 535 | 615 | 76 | 535 | 615 | 76 |
| *Acidaminococcus* sp. D21 gi\|227824983\|ref\| ZP_03989815.1 | SEQ ID NO: 319 | 167 | 306 | 140 | 511 | 591 | 75 | 511 | 591 | 75 |
| *Lactobacillus farciminis* KCTC 3681 gi\|336394882\|ref\| ZP_08576281.1 | SEQ ID NO: 320 | 171 | 310 | 140 | 542 | 621 | 85 | 542 | 621 | 85 |
| *Streptococcus sanguinis* SK49 gi\|422884106\|ref\| ZP_16930555.1 | SEQ ID NO: 321 | 185 | 324 | 140 | 411 | 490 | 85 | 411 | 490 | 85 |
| *Coprococcus catus* GD-7 gi\|291520705\|emb\| CBK78998.1\| | SEQ ID NO: 322 | 172 | 310 | 139 | 556 | 634 | 76 | 556 | 634 | 76 |
| *Streptococcus mutans* UA159 gi\|24379809\|ref\| NP_721764.1\| | SEQ ID NO: 1 | 176 | 314 | 139 | 392 | 470 | 84 | 392 | 470 | 84 |
| *Streptococcus pyogenes* M1 GAS gi\|13622193\|gb\| AAK33936.1\| | SEQ ID NO: 2 | 176 | 314 | 139 | 523 | 600 | 82 | 523 | 600 | 82 |
| *Streptococcus thermophilus* LMD-9 gi\|116628213\|ref\| YP_820832.1\| | SEQ ID NO: 3 | 176 | 314 | 139 | 481 | 558 | 81 | 481 | 558 | 81 |
| *Fusobacterium nucleatum* ATCC 49256 gi\|34762592\|ref\| ZP_00143587.1\| | SEQ ID NO: 326 | 171 | 308 | 138 | 537 | 614 | 76 | 537 | 614 | 76 |
| *Planococcus antarcticus* DSM 14505 gi\|389815359\|ref\| ZP_10206685.1 | SEQ ID NO: 327 | 162 | 299 | 138 | 538 | 614 | 94 | 538 | 614 | 94 |
| *Treponema denticola* ATCC 35405 gi\|42525843\|ref\| NP_970941.1\| | SEQ ID NO: 328 | 169 | 305 | 137 | 524 | 600 | 81 | 524 | 600 | 81 |
| *Solobacterium moorei* F0204 gi\|320528778\|ref\| ZP_08029929.1 | SEQ ID NO: 329 | 179 | 314 | 136 | 544 | 619 | 77 | 544 | 619 | 77 |

TABLE 12-continued

Amino Acid Sequence of Cas9 Orthologs

| Species/ Composite ID | Amino acid sequence | REC2 | | | REC1$_{CT}$ | | | Rec$_{sub}$ | | |
|---|---|---|---|---|---|---|---|---|---|---|
| | | start (AA pos) | stop (AA pos) | # AA deleted | start (AA pos) | stop (AA pos) | # AA deleted | start (AA pos) | stop (AA pos) | # AA deleted |
| *Staphylococcus pseudintermedius* ED99 gi\|323463801\|gb\| ADX75954.1\| | SEQ ID NO: 330 | 164 | 299 | 136 | 531 | 606 | 92 | 531 | 606 | 92 |
| *Flavobacterium branchiophilum* FL-15 gi\|347536497\|ref\| YP_004843922.1 | SEQ ID NO: 331 | 162 | 286 | 125 | 538 | 613 | 63 | 538 | 613 | 63 |
| *Ignavibacterium album* JCM 16511 gi\|385811609\|ref\| YP_005848005.1 | SEQ ID NO: 332 | 223 | 329 | 107 | 357 | 432 | 90 | 357 | 432 | 90 |
| *Bergeyella zoohelcum* ATCC 43767 gi\|423317190\|ref\| ZP_17295095.1 | SEQ ID NO: 333 | 165 | 261 | 97 | 529 | 604 | 56 | 529 | 604 | 56 |
| *Nitrobacter hamburgensis* X14 gi\|92109262\|ref\| YP_571550.1\| | SEQ ID NO: 334 | 169 | 253 | 85 | 536 | 611 | 48 | 536 | 611 | 48 |
| *Odoribacter laneus* YIT 12061 gi\|374384763\|ref\| ZP_09642280.1 | SEQ ID NO: 335 | 164 | 242 | 79 | 535 | 610 | 63 | 535 | 610 | 63 |
| *Legionella pneumophila* str. Paris gi\|54296138\|ref\| YP_122507.1\| | SEQ ID NO: 336 | 164 | 239 | 76 | 402 | 476 | 67 | 402 | 476 | 67 |
| *Bacteroides* sp. 20_3 gi\|301311869\|ref\| ZP_07217791.1 | SEQ ID NO: 337 | 198 | 269 | 72 | 530 | 604 | 83 | 530 | 604 | 83 |
| *Akkermansia muciniphila* ATCC BAA-835 gi\|187736489\|ref\| YP_001878601. | SEQ ID NO: 338 | 136 | 202 | 67 | 348 | 418 | 62 | 348 | 418 | 62 |
| *Prevotella* sp. C561 gi\|345885718\|ref\| ZP_08837074.1 | SEQ ID NO: 339 | 184 | 250 | 67 | 357 | 425 | 78 | 357 | 425 | 78 |
| *Wolinella succinogenes* DSM 1740 gi\|34557932\|ref\| NP_907747.1\| | SEQ ID NO: 340 | 157 | 218 | 36 | 401 | 468 | 60 | 401 | 468 | 60 |
| *Alicyclobacillus hesperidum* URH17-3-68 gi\|403744858\|ref\| ZP_10953934.1 | SEQ ID NO: 341 | 142 | 196 | 55 | 416 | 482 | 61 | 416 | 482 | 61 |
| *Caenispirillum salinarum* AK4 gi\|427429481\|ref\| ZP_18919511.1 | SEQ ID NO: 342 | 161 | 214 | 54 | 330 | 393 | 68 | 330 | 393 | 68 |
| *Eubacterium rectale* ATCC 33656 gi\|238924075\|ref\| YP_002937591.1 | SEQ ID NO: 343 | 133 | 185 | 53 | 322 | 384 | 60 | 322 | 384 | 60 |
| *Mycoplasma synoviae* 53 gi\|71894592\|ref\| YP_278700.1\| | SEQ ID NO: 344 | 187 | 239 | 53 | 319 | 381 | 80 | 319 | 381 | 80 |

TABLE 12-continued

Amino Acid Sequence of Cas9 Orthologs

| Species/ Composite ID | Amino acid sequence | REC2 | | | REC1$_{CT}$ | | | Rec$_{sub}$ | | |
|---|---|---|---|---|---|---|---|---|---|---|
| | | start (AA pos) | stop (AA pos) | # AA deleted | start (AA pos) | stop (AA pos) | # AA deleted | start (AA pos) | stop (AA pos) | # AA deleted |
| *Porphyromonas* sp. oral taxon 279 str. F0450 gi\|402847315\|ref\| ZP_10895610.1 | SEQ ID NO: 345 | 150 | 202 | 53 | 309 | 371 | 60 | 309 | 371 | 60 |
| *Streptococcus thermophilus* LMD-9 gi\|116627542\|ref\| YP_820161.1\| | SEQ ID NO: 346 | 127 | 178 | 139 | 424 | 486 | 81 | 424 | 486 | 81 |
| *Roseburia inulinivorans* DSM 16841 gi\|225377804\|ref\| ZP_03755025.1 | SEQ ID NO: 347 | 154 | 204 | 51 | 318 | 380 | 69 | 318 | 380 | 69 |
| *Methylosinus trichosporium* OB3b gi\|296446027\|ref\| ZP_06887976.1 | SEQ ID NO: 348 | 144 | 193 | 50 | 426 | 488 | 64 | 426 | 488 | 64 |
| *Ruminococcus albus* 8 gi\|325677756\|ref\| ZP_08157403.1 | SEQ ID NO: 349 | 139 | 187 | 49 | 351 | 412 | 55 | 351 | 412 | 55 |
| *Bifidobacterium longum* DJO10A gi\|189440764\|ref\| YP_001955845. | SEQ ID NO: 350 | 183 | 230 | 48 | 370 | 431 | 44 | 370 | 431 | 44 |
| *Enterococcus faecalis* TX0012 gi\|315149830\|gb\| EFT93846.1\| | SEQ ID NO: 351 | 123 | 170 | 48 | 327 | 387 | 60 | 327 | 387 | 60 |
| *Mycoplasma mobile* 163K gi\|47458868\|ref\| YP_015730.1\| | SEQ ID NO: 352 | 179 | 226 | 48 | 314 | 374 | 79 | 314 | 374 | 79 |
| *Actinomyces coleocanis* DSM 15436 gi\|227494853\|ref\| ZP_03925169.1 | SEQ ID NO: 353 | 147 | 193 | 47 | 358 | 418 | 40 | 358 | 418 | 40 |
| *Dinoroseobacter shibae* DFL 12 gi\|159042956\|ref\| YP_001531750.1 | SEQ ID NO: 354 | 138 | 184 | 47 | 338 | 398 | 48 | 338 | 398 | 48 |
| *Actinomyces* sp. oral taxon 180 str. F0310 gi\|315605738\|ref\| ZP_07880770.1 | SEQ ID NO: 355 | 183 | 228 | 46 | 349 | 409 | 40 | 349 | 409 | 40 |
| *Alcanivorax* sp. W11-5 gi\|407803669\|ref\| ZP_11150502.1 | SEQ ID NO: 356 | 139 | 183 | 45 | 344 | 404 | 61 | 344 | 404 | 61 |
| *Aminomonas paucivorans* DSM 12260 gi\|312879015\|ref\| ZP_07738815.1 | SEQ ID NO: 357 | 134 | 178 | 45 | 341 | 401 | 63 | 341 | 401 | 63 |
| *Mycoplasma canis* PG 14 gi\|384393286\|gb\| EIE39736.1\| | SEQ ID NO: 358 | 139 | 183 | 45 | 319 | 379 | 76 | 319 | 379 | 76 |
| *Lactobacillus coryniformis* KCTC 3535 gi\|336393381\|ref\| ZP_08574780.1 | SEQ ID NO: 359 | 141 | 184 | 44 | 328 | 387 | 61 | 328 | 387 | 61 |
| *Elusimicrobium minutum* Pei191 gi\|187250660\|ref\| YP_001875142.1 | SEQ ID NO: 360 | 177 | 219 | 43 | 322 | 381 | 47 | 322 | 381 | 47 |

TABLE 12-continued

Amino Acid Sequence of Cas9 Orthologs

| Species/ Composite ID | Amino acid sequence | REC2 | | | REC1$_{CT}$ | | | Rec$_{sub}$ | | |
|---|---|---|---|---|---|---|---|---|---|---|
| | | start (AA pos) | stop (AA pos) | # AA deleted | start (AA pos) | stop (AA pos) | # AA deleted | start (AA pos) | stop (AA pos) | # AA deleted |
| *Neisseria meningitidis* Z2491 gi\|218767588\|ref\| YP_002342100.1 | SEQ ID NO: 25 | 147 | 189 | 43 | 360 | 419 | 61 | 360 | 419 | 61 |
| *Pasteurella multocida* str. Pm70 gi\|15602992\|ref\| NP_246064.1\| | SEQ ID NO: 362 | 139 | 181 | 43 | 319 | 378 | 61 | 319 | 378 | 61 |
| *Rhodovulum* sp. PH10 gi\|402849997\|ref\| ZP_10898214.1 | SEQ ID NO: 363 | 141 | 183 | 43 | 319 | 378 | 48 | 319 | 378 | 48 |
| *Eubacterium dolichum* DSM 3991 gi\|160915782\|ref\| ZP_02077990.1 | SEQ ID NO: 364 | 131 | 172 | 42 | 303 | 361 | 59 | 303 | 361 | 59 |
| *Nitratifractor salsuginis* DSM 16511 gi\|319957206\|ref\| YP_004168469.1 | SEQ ID NO: 365 | 143 | 184 | 42 | 347 | 404 | 61 | 347 | 404 | 61 |
| *Rhodospirillum rubrum* ATCC 11170 gi\|83591793\|ref\| YP_425545.1\| | SEQ ID NO: 366 | 139 | 180 | 42 | 314 | 371 | 55 | 314 | 371 | 55 |
| *Clostridium cellulolyticum* H10 gi\|220930482\|ref\| YP_002507391.1 | SEQ ID NO: 367 | 137 | 176 | 40 | 320 | 376 | 61 | 320 | 376 | 61 |
| *Helicobacter mustelae* 12198 gi\|291276265\|ref\| YP_003516037.1 | SEQ ID NO: 368 | 148 | 187 | 40 | 298 | 354 | 48 | 298 | 354 | 48 |
| *Ilyobacter polytropus* DSM 2926 gi\|310780384\|ref\| YP_003968716.1 | SEQ ID NO: 369 | 134 | 173 | 40 | 462 | 517 | 63 | 462 | 517 | 63 |
| *Sphaerochaeta globus* str. Buddy gi\|325972003\|ref\| YP_004248194.1 | SEQ ID NO: 370 | 163 | 202 | 40 | 335 | 389 | 45 | 335 | 389 | 45 |
| *Staphylococcus lugdunensis* M23590 gi\|315659848\|ref\| ZP_07912707.1 | SEQ ID NO: 371 | 128 | 167 | 40 | 337 | 391 | 57 | 337 | 391 | 57 |
| *Treponema* sp. JC4 gi\|384109266\|ref\| ZP_10010146.1 | SEQ ID NO: 372 | 144 | 183 | 40 | 328 | 382 | 63 | 328 | 382 | 63 |
| uncultured delta proteobacterium HF0070 07E19 gi\|297182908\|gb\| ADI19058.1\| | SEQ ID NO: 373 | 154 | 193 | 40 | 313 | 365 | 55 | 313 | 365 | 55 |
| *Alicycliphilus denitrificans* K601 gi\|330822845\|ref\| YP_004386148.1 | SEQ ID NO: 374 | 140 | 178 | 39 | 317 | 366 | 48 | 317 | 366 | 48 |
| *Azospirillum* sp. B510 gi\|288957741\|ref\| YP_003448082.1 | SEQ ID NO: 375 | 205 | 243 | 39 | 342 | 389 | 46 | 342 | 389 | 46 |

TABLE 12-continued

Amino Acid Sequence of Cas9 Orthologs

| Species/Composite ID | Amino acid sequence | REC2 | | | REC1$_{CT}$ | | | Rec$_{sub}$ | | |
|---|---|---|---|---|---|---|---|---|---|---|
| | | start (AA pos) | stop (AA pos) | # AA deleted | start (AA pos) | stop (AA pos) | # AA deleted | start (AA pos) | stop (AA pos) | # AA deleted |
| *Bradyrhizobium* sp. BTAi1 gi\|148255343\|ref\|YP_001239928.1 | SEQ ID NO: 376 | 143 | 181 | 39 | 323 | 370 | 48 | 323 | 370 | 48 |
| *Parvibaculum lavamentivorans* DS-1 gi\|154250555\|ref\|YP_001411379.1 | SEQ ID NO: 377 | 138 | 176 | 39 | 327 | 374 | 58 | 327 | 374 | 58 |
| *Prevotella timonensis* CRIS 5C-B1 gi\|282880052\|ref\|ZP_06288774.1 | SEQ ID NO: 378 | 170 | 208 | 39 | 328 | 375 | 61 | 328 | 375 | 61 |
| *Bacillus smithii* 7 3 47FAA gi\|365156657\|ref\|ZP_09352959.1 | SEQ ID NO: 379 | 134 | 171 | 38 | 401 | 448 | 63 | 401 | 448 | 63 |
| *Candidatus Puniceispirillum marinum* IMCC1322 gi\|294086111\|ref\|YP_003552871.1 | SEQ ID NO: 380 | 135 | 172 | 38 | 344 | 391 | 53 | 344 | 391 | 53 |
| *Barnesiella intestinihominis* YIT 11860 gi\|404487228\|ref\|ZP_11022414.1 | SEQ ID NO: 381 | 140 | 176 | 37 | 371 | 417 | 60 | 371 | 417 | 60 |
| *Ralstonia syzygii* R24 gi\|344171927\|emb\|CCA84553.1\| | SEQ ID NO: 382 | 140 | 176 | 37 | 395 | 440 | 50 | 395 | 440 | 50 |
| *Wolinella succinogenes* DSM 1740 gi\|34557790\|ref\|NP_907605.1\| | SEQ ID NO: 383 | 145 | 180 | 36 | 348 | 392 | 60 | 348 | 392 | 60 |
| *Mycoplasma gallisepticum* str. F gi\|284931710\|gb\|ADC31648.1 | SEQ ID NO: 384 | 144 | 177 | 34 | 373 | 416 | 71 | 373 | 416 | 71 |
| *Acidothermus cellulolyticus* 11B gi\|117929158\|ref\|YP_873709.1\| | SEQ ID NO: 385 | 150 | 182 | 33 | 341 | 380 | 58 | 341 | 380 | 58 |
| *Mycoplasma ovipneumoniae* SC01 gi\|363542550\|ref\|ZP_09312133.1 | SEQ ID NO: 386 | 156 | 184 | 29 | 381 | 420 | 62 | 381 | 420 | 62 |

TABLE 13

Amino Acid Sequence of Cas9 Core Domains

| Strain Name | Cas9 Start (AA pos) Start and Stop numbers refer to the sequence in Table 11 | Cas9 Stop (AA pos) |
|---|---|---|
| Staphylococcus aureus | 1 | 772 |
| Streptococcus pyogenes | 1 | 1099 |
| Campulobacter jejuni | 1 | 741 |

TABLE 14

Identified PAM sequences and corresponding RKR motifs.

| Strain Name | PAM sequence (NA) | RKR motif (AA) |
|---|---|---|
| Streptococcus pyogenes | NGG | RKR |
| Streptococcus mutans | NGG | RKR |
| Streptococcus thermophilus A | NGGNG | RYR |
| Treponema denticola | NAAAAN | VAK |
| Streptococcus thermophilus B | NNAAAAW | IYK |
| Campylobacter jejuni | NNNNACA | NLK |
| Pasteurella multocida | GNNNCNNA | KDG |
| Neisseria meningitidis | NNNNGATT or | IGK |
| Staphylococcus aureus | NNGRRV (R = A or G; V = A. G or C) NNGRRT (R = A or G) | NDK |

PI domains are provided in Tables 15 and 16.

TABLE 15

Altered PI Domains

| Strain Name | PI Start (AA pos) Start and Stop numbers refer to the sequences in Table 11 | PI Stop (AA pos) | Length of PI (AA) | RKR motif (AA) |
|---|---|---|---|---|
| Alicycliphilus denitrificans K601 | 837 | 1029 | 193 | --Y |
| Campylobacter jejuni NCTC 11168 | 741 | 984 | 244 | -NG |
| Helicobacter mustelae 12198 | 771 | 1024 | 254 | -NQ |

TABLE 16

Other Altered PI Domains

| Strain Name | PI Start (AA pos) Start and Stop numbers refer to the sequences in Table 11 | PI Stop (AA pos) | Length of PI (AA) | RKR motif (AA) |
|---|---|---|---|---|
| Akkermansia muciniphila ATCC BAA-835 | 871 | 1101 | 231 | ALK |
| Ralstonia syzygii R24 | 821 | 1062 | 242 | APY |
| Cand. Puniceispirillum marinum IMCC1322 | 815 | 1035 | 221 | AYK |
| Fructobacillus fructosus KCTC 3544 | 1074 | 1323 | 250 | DGN |
| Eubacterium yurii ATCC 43715 | 1107 | 1391 | 285 | DGY |
| Eubacterium dolichum DSM 3991 | 779 | 1096 | 318 | DKK |
| Dinoroseobacter shibae DFL 12 | 851 | 1079 | 229 | DPI |
| Clostridium cellulolyticum H10 | 767 | 1021 | 255 | EGK |
| Pasteurella multocida str. Pm70 | 815 | 1056 | 242 | ENN |
| Mycoplasma canis PG 14 | 907 | 1233 | 327 | EPK |
| Porphyromonas sp. oral taxon 279 str. F0450 | 935 | 1197 | 263 | EPT |
| Filifactor alocis ATCC 35896 | 1094 | 1365 | 272 | EVD |
| Aminomonas paucivorans DSM 12260 | 801 | 1052 | 252 | EVY |
| Wolinella succinogenes DSM 1740 | 1034 | 1409 | 376 | EYK |
| Oenococcus kitaharae DSM 17330 | 1119 | 1389 | 271 | GAL |
| CoriobacteriumglomeransPW2 | 1126 | 1384 | 259 | GDR |
| Peptoniphilus duerdenii ATCC BAA-1640 | 1091 | 1364 | 274 | GDS |
| Bifidobacterium bifidum S17 | 1138 | 1420 | 283 | GGL |
| Alicyclobacillus hesperidum URH17-3-68 | 876 | 1146 | 271 | GGR |
| Roseburia inulinivorans DSM 16841 | 895 | 1152 | 258 | GGT |
| Actinomyces coleocanis DSM 15436 | 843 | 1105 | 263 | GKK |
| Odoribacter laneus YIT 12061 | 1103 | 1498 | 396 | GKV |

TABLE 16-continued

Other Altered PI Domains

| Strain Name | PI Start (AA pos) Start and Stop numbers refer to the sequences in Table 11 | PI Stop (AA pos) | Length of PI (AA) | RKR motif (AA) |
|---|---|---|---|---|
| Coprococcus catus GD-7 | 1063 | 1338 | 276 | GNQ |
| Enterococcus faecalis TX0012 | 829 | 1150 | 322 | GRK |
| Bacillus smithii 7 3 47FAA | 809 | 1088 | 280 | GSK |
| Legionella pneumophila str. Paris | 1021 | 1372 | 352 | GTM |
| Bacteroides fragilis NCTC 9343 | 1140 | 1436 | 297 | IPV |
| Mycoplasma ovipneumoniae SC01 | 923 | 1265 | 343 | IRI |
| Actinomyces sp. oral taxon 180 str. F0310 | 895 | 1181 | 287 | KEK |
| Treponema sp. JC4 | 832 | 1062 | 231 | KIS |
| Fusobacteriumnucleatum ATCC49256 | 1073 | 1374 | 302 | KKV |
| Lactobacillus farciminis KCTC 3681 | 1101 | 1356 | 256 | KKV |
| Nitratifractor salsuginis DSM 16511 | 840 | 1132 | 293 | KMR |
| Lactobacillus coryniformis KCTC 3535 | 850 | 1119 | 270 | KNK |
| Mycoplasma mobile 163K | 916 | 1236 | 321 | KNY |
| Flavobacterium branchiophilum FL-15 | 1182 | 1473 | 292 | KQK |
| Prevotella timonensis CRIS 5C-B1 | 957 | 1218 | 262 | KQQ |
| Methylosinus trichosporium OB3b | 830 | 1082 | 253 | KRP |
| Prevotella sp. C561 | 1099 | 1424 | 326 | KRY |
| Mycoplasma gallisepticum str. F | 911 | 1269 | 359 | KTA |
| Lactobacillus rhamnosus GG | 1077 | 1363 | 287 | KYG |
| Wolinella succinogenes DSM 1740 | 811 | 1059 | 249 | LPN |
| Streptococcus thermophilus LMD-9 | 1099 | 1388 | 290 | MLA |
| Treponema denticola ATCC 35405 | 1092 | 1395 | 304 | NDS |
| Bergeyella zoohelcum ATCC 43767 | 1098 | 1415 | 318 | NEK |
| Veillonella atypica ACS-134-V-Col7a | 1107 | 1398 | 292 | NGF |
| Neisseria meningitidis Z2491 | 835 | 1082 | 248 | NHN |
| Ignavibacterium album JCM 16511 | 1296 | 1688 | 393 | NKK |
| Ruminococcus albus 8 | 853 | 1156 | 304 | NNF |
| Streptococcus thermophilus LMD-9 | 811 | 1121 | 311 | NNK |
| Barnesiella intestinihominis YIT 11860 | 871 | 1153 | 283 | NPV |
| Azospirillum sp. B510 | 911 | 1168 | 258 | PFH |
| Rhodospirillum rubrum ATCC 11170 | 863 | 1173 | 311 | PRG |
| Planococcus antarcticus DSM 14505 | 1087 | 1333 | 247 | PYY |
| Staphylococcus pseudintermedius ED99 | 1073 | 1334 | 262 | QIV |
| Alcanivorax sp. W11-5 | 843 | 1113 | 271 | RIE |
| Bradyrhizobium sp. BTAi1 | 811 | 1064 | 254 | RIY |
| Streptococcus pyogenes M1 GAS | 1099 | 1368 | 270 | RKR |
| Streptococcus mutans UA159 | 1078 | 1345 | 268 | RKR |
| Streptococcus Pyogenes | 1099 | 1368 | 270 | RKR |
| Bacteroides sp. 20 3 | 1147 | 1517 | 371 | RNI |
| S. aureus | 772 | 1053 | 282 | RNK |
| Solobacterium moorei F0204 | 1062 | 1327 | 266 | RSG |
| Finegoldia magna ATCC 29328 | 1081 | 1348 | 268 | RTE |
| uncultured delta proteobacterium HF0070 07E19 | 770 | 1011 | 242 | SGG |
| Acidaminococcus sp. D21 | 1064 | 1358 | 295 | SIG |
| Eubacterium rectale ATCC 33656 | 824 | 1114 | 291 | SKK |
| Caenispirillum salinarum AK4 | 1048 | 1442 | 395 | SLV |
| Acidothermus cellulolyticus 11B | 830 | 1138 | 309 | SPS |
| Catenibacterium mitsuokai DSM 15897 | 1068 | 1329 | 262 | SPT |
| Parvibaculum lavamentivorans DS-1 | 827 | 1037 | 211 | TGN |
| Staphylococcus lugdunensis M23590 | 772 | 1054 | 283 | TKK |
| Streptococcus sanguinis SK49 | 1123 | 1421 | 299 | TRM |
| Elusimicrobium minutum Pei191 | 910 | 1195 | 286 | TTG |
| Nitrobacter hamburgensis X14 | 914 | 1166 | 253 | VAY |
| Mycoplasma synoviae 53 | 991 | 1314 | 324 | VGF |
| Sphaerochaeta globus str. Buddy | 877 | 1179 | 303 | VKG |
| Ilyobacter polytropus DSM 2926 | 837 | 1092 | 256 | VNG |
| Rhodovulum sp. PH10 | 821 | 1059 | 239 | VPY |
| Bifidobacterium longum DJO10A | 904 | 1187 | 284 | VRK |

Nucleic Acids Encoding Cas9 Molecules

Nucleic acids encoding the Cas9 molecules or Cas9 polypeptides, e.g., an eaCas9 molecule or eaCas9 polypeptide, are provided herein.

Exemplary nucleic acids encoding Cas9 molecules or Cas9 polypeptides are described in Cong 2013; Wang 2013; Mali 2013; and Jinek 2012. Another exemplary nucleic acid encoding a Cas9 molecule or Cas9 polypeptide is shown in black in FIG. 8.

In an embodiment, a nucleic acid encoding a Cas9 molecule or Cas9 polypeptide can be a synthetic nucleic acid sequence. For example, the synthetic nucleic acid molecule can be chemically modified, e.g., as described in Section VIII. In an embodiment, the Cas9 mRNA has one or more (e.g., all of the following properties: it is capped, polyadenylated, substituted with 5-methylcytidine and/or pseudouridine.

In addition, or alternatively, the synthetic nucleic acid sequence can be codon optimized, e.g., at least one non-common codon or less-common codon has been replaced by a common codon. For example, the synthetic nucleic acid can direct the synthesis of an optimized messenger mRNA, e.g., optimized for expression in a mammalian expression system, e.g., described herein.

In addition, or alternatively, a nucleic acid encoding a Cas9 molecule or Cas9 polypeptide may comprise a nuclear localization sequence (NLS). Nuclear localization sequences are known in the art.

An exemplary codon optimized nucleic acid sequence encoding a Cas9 molecule of *S. pyogenes* is set forth in SEQ ID NO: 22. The corresponding amino acid sequence is set forth in SEQ ID NO: 2.

An exemplary codon optimized nucleic acid sequence encoding a Cas9 molecule of *N. meningitidis* is set forth in SEQ ID NO: 24. The corresponding amino acid sequence is set forth in SEQ ID NO: 25.

An amino acid sequence of a *S. aureus* Cas9 molecule is set forth in SEQ ID NO: 26. An exemplary codon optimized nucleic acid sequence encoding a Cas9 molecule of *S. aureus* is set forth in SEQ ID NO: 39.

If any of the above Cas9 sequences are fused with a peptide or polypeptide at the C-terminus, it is understood that the stop codon will be removed.

Other Cas Molecules and Cas Polypeptides

Various types of Cas molecules or Cas polypeptides can be used to practice the inventions disclosed herein. In some embodiments, Cas molecules of Type II Cas systems are used. In other embodiments, Cas molecules of other Cas systems are used. For example, Type I or Type III Cas molecules may be used. Exemplary Cas molecules (and Cas systems) are described, e.g., in Haft 2005 and Makarova 2011, the contents of both references are incorporated herein by reference in their entirety. Exemplary Cas molecules (and Cas systems) are also shown in Table 17.

TABLE 17

Cas Systems

| Gene name‡ | System type or subtype | Name from Haft 2005§ | Structure of encoded protein (PDB accessions)¶ | Families (and superfamily) of encoded protein#** | Representatives |
|---|---|---|---|---|---|
| cas1 | Type I<br>Type II<br>Type III | cas1 | 3GOD, 3LFX and 2YZS | COG1518 | SERP2463, SPy1047 and ygbT |
| cas2 | Type I<br>Type II<br>Type III | cas2 | 2IVY, 2I8E and 3EXC | COG1343 and COG3512 | SERP2462, SPy1048, SPy1723 (N-terminal domain) and ygbF |
| cas3' | Type I‡‡ | cas3 | NA | COG1203 | APE1232 and ygcB |
| cas3" | Subtype I-A<br>Subtype I-B | NA | NA | COG2254 | APE1231 and BH0336 |
| cas4 | Subtype I-A<br>Subtype I-B<br>Subtype I-C<br>Subtype I-D<br>Subtype II-B | cas4 and csa1 | NA | COG1468 | APE1239 and BH0340 |
| cas5 | Subtype I-A<br>Subtype I-B<br>Subtype I-C<br>Subtype I-E | cas5a, cas5d, cas5e, cas5h, cas5p, cas5t and cmx5 | 3KG4 | COG1688 (RAMP) | APE1234, BH0337, devS and ygcI |

TABLE 17-continued

| | | | | Cas Systems | | |
|---|---|---|---|---|---|---|
| Gene name[‡] | System type or subtype | Name from Haft 2005[§] | Structure of encoded protein (PDB accessions)[¶] | Families (and superfamily) of encoded protein[#][**] | Representatives | |
| cas6 | Subtype I-A Subtype I-B Subtype I-D Subtype III-A Subtype III-B | cas6 and cmx6 | 3I4H | COG1583 and COG5551 (RAMP) | PF1131 and slr7014 | |
| cas6e | Subtype I-E | cse3 | 1WJ9 | (RAMP) | ygcH | |
| cas6f | Subtype I-F | csy4 | 2XLJ | (RAMP) | y1727 | |
| cas7 | Subtype I-A Subtype I-B Subtype I-C Subtype I-E | csa2, csd2, cse4, csh2, csp1 and cst2 | NA | COG1857 and COG3649 (RAMP) | devR and ygcJ | |
| cas8a1 | Subtype I-A[‡‡] | cmx1, cst1, csx8, csx13 and CXXC-CXXC | NA | BH0338-like | LA3191[§§] and PG2018[§§] | |
| cas8a2 | Subtype I-A[‡‡] | csa4 and csx9 | NA | PH0918 | AF0070, AF1873, MJ0385, PF0637, PH0918 and SSO1401 | |
| cas8b | Subtype I-B[‡‡] | csh1 and TM1802 | NA | BH0338-like | MTH1090 and TM1802 | |
| cas8c | Subtype I-C[‡‡] | csd1 and csp2 | NA | BH0338-like | BH0338 | |
| cas9 | Type II[‡‡] | csn1 and csx12 | NA | COG3513 | FTN_0757 and SPy1046 | |
| cas10 | Type III[‡‡] | cmr2, csm1 and csx11 | NA | COG1353 | MTH326, Rv2823c[§§] and TM1794[§§] | |
| cas10d | Subtype I-D[‡‡] | csc3 | NA | COG1353 | slr7011 | |
| csy1 | Subtype I-F[‡‡] | csy1 | NA | y1724-like | y1724 | |
| csy2 | Subtype I-F | csy2 | NA | (RAMP) | y1725 | |
| csy3 | Subtype I-F | csy3 | NA | (RAMP) | y1726 | |
| cse1 | Subtype I-E[‡‡] | cse1 | NA | YgcL-like | ygcL | |
| cse2 | Subtype I-E | cse2 | 2ZCA | YgcK-like | ygcK | |
| csc1 | Subtype I-D | csc1 | NA | alr1563-like (RAMP) | alr1563 | |
| csc2 | Subtype I-D | csc1 and csc2 | NA | COG1337 (RAMP) | slr7012 | |
| csa5 | Subtype I-A | csa5 | NA | AF1870 | AF1870, MJ0380, PF0643 and SSO1398 | |
| csn2 | Subtype II-A | csn2 | NA | SPy1049-like | SPy1049 | |
| csm2 | Subtype III-A[‡‡] | csm2 | NA | COG1421 | MTH1081 and SERP2460 | |
| csm3 | Subtype III-A | csc2 and csm3 | NA | COG1337 (RAMP) | MTH1080 and SERP2459 | |
| csm4 | Subtype III-A | csm4 | NA | COG1567 (RAMP) | MTH1079 and SERP2458 | |
| csm5 | Subtype III-A | csm5 | NA | COG1332 (RAMP) | MTH1078 and SERP2457 | |
| csm6 | Subtype III-A | APE2256 and csm6 | 2WTE | COG1517 | APE2256 and SSO1445 | |
| cmr1 | Subtype III-B | cmr1 | NA | COG1367 (RAMP) | PF1130 | |

TABLE 17-continued

Cas Systems

| Gene name[‡] | System type or subtype | Name from Haft 2005[§] | Structure of encoded protein (PDB accessions)[¶] | Families (and superfamily) of encoded protein[#,**] | Representatives |
|---|---|---|---|---|---|
| cmr3 | Subtype III-B | cmr3 | NA | COG1769 (RAMP) | PF1128 |
| cmr4 | Subtype III-B | cmr4 | NA | COG1336 (RAMP) | PF1126 |
| cmr5 | Subtype III-B[‡‡] | cmr5 | 2ZOP and 2OEB | COG3337 | MTH324 and PF1125 |
| cmr6 | Subtype III-B | cmr6 | NA | COG1604 (RAMP) | PF1124 |
| csb1 | Subtype I-U | GSU0053 | NA | (RAMP) | Balac_1306 and GSU0053 |
| csb2 | Subtype I-U[§§] | NA | NA | (RAMP) | Balac_1305 and GSU0054 |
| csb3 | Subtype I-U | NA | NA | (RAMP) | Balac_1303[§§] |
| csx17 | Subtype I-U | NA | NA | NA | Btus_2683 |
| csx14 | Subtype I-U | NA | NA | NA | GSU0052 |
| csx10 | Subtype I-U | csx10 | NA | (RAMP) | Caur_2274 |
| csx16 | Subtype III-U | VVA1548 | NA | NA | VVA1548 |
| csaX | Subtype III-U | csaX | NA | NA | SSO1438 |
| csx3 | Subtype III-U | csx3 | NA | NA | AF1864 |
| csx1 | Subtype III-U | csa3, csx1, csx2, DXTHG, NE0113 and TIGR02710 | 1XMX and 2I71 | COG1517 and COG4006 | MJ1666, NE0113, PF1127 and TM1812 |
| csx15 | Unknown | NA | NA | TTE2665 | TTE2665 |
| csf1 | Type U | csf1 | NA | NA | AFE_1038 |
| csf2 | Type U | csf2 | NA | (RAMP) | AFE_1039 |
| csf3 | Type U | csf3 | NA | (RAMP) | AFE_1040 |
| csf4 | Type U | csf4 | NA | NA | AFE_1037 |

V. Functional Analysis of Candidate Molecules

Candidate Cas9 molecules, candidate gRNA molecules, candidate Cas9 molecule/gRNA molecule complexes, can be evaluated by art-known methods or as described herein. For example, exemplary methods for evaluating the endonuclease activity of Cas9 molecule are described, e.g., in Jinek 2012.

Binding and Cleavage Assay: Testing the Endonuclease Activity of Cas9 Molecule

The ability of a Cas9 molecule/gRNA molecule complex to bind to and cleave a target nucleic acid can be evaluated in a plasmid cleavage assay. In this assay, synthetic or in vitro-transcribed gRNA molecule is pre-annealed prior to the reaction by heating to 95° C. and slowly cooling down to room temperature. Native or restriction digest-linearized plasmid DNA (300 ng (~8 nM)) is incubated for 60 min at 37° C. with purified Cas9 protein molecule (50-500 nM) and gRNA (50-500 nM, 1:1) in a Cas9 plasmid cleavage buffer (20 mM HEPES pH 7.5, 150 mM KCl, 0.5 mM DTT, 0.1 mM EDTA) with or without 10 mM $MgCl_2$. The reactions are stopped with 5×DNA loading buffer (30% glycerol, 1.2% SDS, 250 mM EDTA), resolved by a 0.8 or 1% agarose gel electrophoresis and visualized by ethidium bromide staining. The resulting cleavage products indicate whether the Cas9 molecule cleaves both DNA strands, or only one of the two strands. For example, linear DNA products indicate the cleavage of both DNA strands. Nicked open circular products indicate that only one of the two strands is cleaved.

Alternatively, the ability of a Cas9 molecule/gRNA molecule complex to bind to and cleave a target nucleic acid can be evaluated in an oligonucleotide DNA cleavage assay. In this assay, DNA oligonucleotides (10 pmol) are radiolabeled by incubating with 5 units T4 polynucleotide kinase and ~3-6 pmol (~20/10 mCi) [γ-32P]-ATP in 1× T4 polynucleotide kinase reaction buffer at 37° C. for 30 min, in a 50 μL reaction. After heat inactivation (65° C. for 20 min), reactions are purified through a column to remove unincorporated label. Duplex substrates (100 nM) are generated by annealing labeled oligonucleotides with equimolar amounts of unlabeled complementary oligonucleotide at 95° C. for 3 min, followed by slow cooling to room temperature. For cleavage assays, gRNA molecules are annealed by heating to 95° C. for 30 s, followed by slow cooling to room temperature. Cas9 (500 nM final concentration) is pre-incubated with the annealed gRNA molecules (500 nM) in cleavage assay buffer (20 mM HEPES pH 7.5, 100 mM KCl, 5 mM MgCl2, 1 mM DTT, 5% glycerol) in a total volume of 9 μl. Reactions are initiated by the addition of 1 μl target DNA (10 nM) and incubated for 1 h at 37° C. Reactions are quenched by the addition of 20 μl of loading dye (5 mM EDTA, 0.025% SDS, 5% glycerol in formamide) and heated to 95° C. for 5 min. Cleavage products are resolved on 12% denaturing polyacrylamide gels containing 7 M urea and visualized by phosphorimaging. The resulting cleavage products indicate that whether the complementary strand, the non-complementary strand, or both, are cleaved.

One or both of these assays can be used to evaluate the suitability of a candidate gRNA molecule or candidate Cas9 molecule.

Binding Assay: Testing the Binding of Cas9 Molecule to Target DNA

Exemplary methods for evaluating the binding of Cas9 molecule to target DNA are described, e.g., in Jinek 2012.

For example, in an electrophoretic mobility shift assay, target DNA duplexes are formed by mixing of each strand (10 nmol) in deionized water, heating to 95° C. for 3 min and slow cooling to room temperature. All DNAs are purified on 8% native gels containing 1× TBE. DNA bands are visualized by UV shadowing, excised, and eluted by soaking gel pieces in DEPC-treated $H_2O$. Eluted DNA is ethanol precipitated and dissolved in DEPC-treated $H_2O$. DNA samples are 5' end labeled with [γ-32P]-ATP using T4 polynucleotide kinase for 30 min at 37° C. Polynucleotide kinase is heat denatured at 65° C. for 20 min, and unincorporated radiolabel is removed using a column. Binding assays are performed in buffer containing 20 mM HEPES pH 7.5, 100 mM KCl, 5 mM $MgCl_2$, 1 mM DTT and 10% glycerol in a total volume of 10 μl. Cas9 protein molecule is programmed with equimolar amounts of pre-annealed gRNA molecule and titrated from 100 pM to 1 μM. Radiolabeled DNA is added to a final concentration of 20 pM. Samples are incubated for 1 h at 37° C. and resolved at 4° C. on an 8% native polyacrylamide gel containing 1× TBE and 5 mM $MgCl_2$. Gels are dried and DNA visualized by phosphorimaging.

Differential Scanning Flourimetry (DSF)

The thermostability of Cas9-gRNA ribonucleoprotein (RNP) complexes can be measured via DSF. This technique measures the thermostability of a protein, which can increase under favorable conditions such as the addition of a binding RNA molecule, e.g., a gRNA.

The assay is performed using two different protocols, one to test the best stoichiometric ratio of gRNA:Cas9 protein and another to determine the best solution conditions for RNP formation.

To determine the best solution to form RNP complexes, a 2 uM solution of Cas9 in water+10× SYPRO Orange® (Life Technologies cat #S-6650) and dispensed into a 384 well plate. An equimolar amount of gRNA diluted in solutions with varied pH and salt is then added. After incubating at room temperature for 10' and brief centrifugation to remove any bubbles, a Bio-Rad CFX384™ Real-Time System C1000 Touch™ Thermal Cycler with the Bio-Rad CFX Manager software is used to run a gradient from 20° C. to 90° C. with a 1° increase in temperature every 10 seconds.

The second assay consists of mixing various concentrations of gRNA with 2 uM Cas9 in optimal buffer from assay 1 above and incubating at RT for 10' in a 384 well plate. An equal volume of optimal buffer+10× SYPRO Orange® (Life Technologies cat #S-6650) is added and the plate sealed with Microseal® B adhesive (MSB-1001). Following brief centrifugation to remove any bubbles, a Bio-Rad CFX384™ Real-Time System C1000 Touch™ Thermal Cycler with the Bio-Rad CFX Manager software is used to run a gradient from 20° C. to 90° C. with a 1° increase in temperature every 10 seconds.

VI. Genome Editing Approaches

While not wishing to be bound by theory, altering the LCA10 target position may be achieved using one of the approaches discussed herein.

NHEJ Approaches for Gene Targeting

As described herein, nuclease-induced non-homologous end-joining (NHEJ) can be used to introduce indels at a target position. Nuclease-induced NHEJ can also be used to remove (e.g., delete) genomic sequence including the mutation at a target position in a gene of interest.

While not wishing to be bound by theory, it is believed that, in an embodiment, the genomic alterations associated with the methods described herein rely on nuclease-induced NHEJ and the error-prone nature of the NHEJ repair pathway. NHEJ repairs a double-strand break in the DNA by joining together the two ends; however, generally, the original sequence is restored only if two compatible ends, exactly as they were formed by the double-strand break, are perfectly ligated. The DNA ends of the double-strand break are frequently the subject of enzymatic processing, resulting in the addition or removal of nucleotides, at one or both strands, prior to rejoining of the ends. This results in the presence of insertion and/or deletion (indel) mutations in the DNA sequence at the site of the NHEJ repair.

The indel mutations generated by NHEJ are unpredictable in nature; however, at a given break site certain indel sequences are favored and are over represented in the population, likely due to small regions of microhomology. The lengths of deletions can vary widely; most commonly in the 1-50 bp range, but they can easily reach greater than 100-200 bp. Insertions tend to be shorter and often include short duplications of the sequence immediately surrounding the break site. However, it is possible to obtain large insertions, and in these cases, the inserted sequence has often been traced to other regions of the genome or to plasmid DNA present in the cells.

Because NHEJ is a mutagenic process, it can also be used to delete small sequence motifs as long as the generation of a specific final sequence is not required. If a double-strand break is targeted near to a short target sequence, the deletion mutations caused by the NHEJ repair often span, and therefore remove, the unwanted nucleotides. For the deletion of larger DNA segments, introducing two double-strand breaks, one on each side of the sequence, can result in NHEJ between the ends with removal of the entire intervening sequence. Both of these approaches can be used to delete specific DNA sequences; however, the error-prone nature of NHEJ may still produce indel mutations at the site of deletion.

Both double strand cleaving eaCas9 molecules and single strand, or nickase, eaCas9 molecules can be used in the methods and compositions described herein to generate break-induced indels.

Double Strand Break

In an embodiment, double strand cleavage is effected by a Cas9 molecule having cleavage activity associated with an HNH-like domain and cleavage activity associated with a RuvC-like domain, e.g., an N-terminal RuvC-like domain, e.g., a wild type Cas9. Such embodiments require only a single gRNA.

Single Strand Break

In other embodiments, two single strand breaks are effected by a Cas9 molecule having nickase activity, e.g., cleavage activity associated with an HNH-like domain or cleavage activity associated with an N-terminal RuvC-like domain. Such embodiments require two gRNAs, one for placement of each single strand break. In an embodiment, the Cas9 molecule having nickase activity cleaves the strand to which the gRNA hybridizes, but not the strand that is complementary to the strand to which the gRNA hybridizes. In an embodiment, the Cas9 molecule having nickase activity does not cleave the strand to which the gRNA hybridizes, but rather cleaves the strand that is complementary to the strand to which the gRNA hybridizes.

In an embodiment, the nickase has HNH activity, e.g., a Cas9 molecule having the RuvC activity inactivated, e.g., a Cas9 molecule having a mutation at D10, e.g., the D10A mutation. D10A inactivates RuvC therefore the Cas9 nickase has (only) HNH activity and will cut on the strand to which the gRNA hybridizes (the complementary strand, which does not have the NGG PAM on it). In other embodiments, a Cas9 molecule having an H840, e.g., an H840A, mutation can be used as a nickase. H840A inactivates HNH therefore the Cas9 nickase has (only) RuvC activity and cuts on the non-complementary strand (the strand that has the NGG PAM and whose sequence is identical to the gRNA). In other embodiments, a Cas9 molecule having an H863, e.g., an H863A, mutation can be used as a nickase. H863A inactivates HNH therefore the Cas9 nickase has (only) RuvC activity and cuts on the non-complementary strand (the strand that has the NGG PAM and whose sequence is identical to the gRNA).

In an embodiment, in which a nickase and two gRNAs are used to position two single strand breaks, one nick is on the + strand and one nick is on the − strand of the target nucleic acid. The PAMs can be outwardly facing. The gRNAs can be selected such that the gRNAs are separated by, from 0-50, 0-100, or 0-200 nucleotides. In an embodiment, there is no overlap between the target sequences that are complementary to the targeting domains of the two gRNAs. In an embodiment, the gRNAs do not overlap and are separated by as much as 50, 100, or 200 nucleotides. In an embodiment, the use of two gRNAs can increase specificity, e.g., by decreasing off-target binding (Ran 2013).

Placement of Double Strand or Single Strand Breaks Relative to the Target Position In an embodiment, in which a gRNA and Cas9 nuclease generate a double strand break for the purpose of inducing break-induced indels, a gRNA, e.g., a unimolecular (or chimeric) or modular gRNA molecule, is configured to position one double-strand break in close proximity to a nucleotide of the target position. In an embodiment, the cleavage site is between 0-40 bp away from the target position (e.g., less than 40, 35, 30, 25, 20, 15, 10, 9, 8, 7, 6, 5, 4, 3, 2 or 1 bp from the target position).

In an embodiment, in which two gRNAs complexing with a Cas9 nickase induce two single strand breaks for the purpose of introducing break-induced indels, two gRNAs, e.g., independently, unimolecular (or chimeric) or modular gRNA, are configured to position two single-strand breaks to provide for NHEJ-mediated alteration of a nucleotide of the target position. In an embodiment, the gRNAs are configured to position cuts at the same position, or within a few nucleotides of one another, on different strands, essentially mimicking a double strand break. In an embodiment, the two nicks are between 0-40 bp away from the target position (e.g., less than 40, 35, 30, 25, 20, 15, 10, 9, 8, 7, 6, 5, 4, 3, 2 or 1 bp from the target position) respectively, and the two single strand breaks are within 25-55 bp of each other (e.g., between 25 to 50, 25 to 45, 25 to 40, 25 to 35, 25 to 30, 50 to 55, 45 to 55, 40 to 55, 35 to 55, 30 to 55, 30 to 50, 35 to 50, 40 to 50, 45 to 50, 35 to 45, or 40 to 45 bp) and no more than 100 bp away from each other (e.g., no more than 90, 80, 70, 60, 50, 40, 30, 20 or 10 bp). In an embodiment, the gRNAs are configured to place a single strand break on either side of the target position. In an embodiment, the gRNAs are configured to place a single strand break on the same side (either 5' or 3') of the target position.

Regardless of whether a break is a double strand or a single strand break, the gRNA should be configured to avoid unwanted target chromosome elements, such as repeated elements, e.g., an Alu repeat, in the target domain. In addition, a break, whether a double strand or a single strand break, should be sufficiently distant from any sequence that should not be altered. For example, cleavage sites positioned within introns should be sufficiently distant from any intron/exon border, or naturally occurring splice signal, to avoid alteration of the exonic sequence or unwanted splicing events.

Single-Strand Annealing

Single strand annealing (SSA) is another DNA repair process that repairs a double-strand break between two repeat sequences present in a target nucleic acid. Repeat sequences utilized by the SSA pathway are generally greater than 30 nucleotides in length. Resection at the break ends occurs to reveal repeat sequences on both strands of the target nucleic acid. After resection, single strand overhangs containing the repeat sequences are coated with RPA protein to prevent the repeats sequences from inappropriate annealing, e.g., to themselves. RAD52 binds to and each of the repeat sequences on the overhangs and aligns the sequences to enable the annealing of the complementary repeat sequences. After annealing, the single-strand flaps of the overhangs are cleaved. New DNA synthesis fills in any gaps, and ligation restores the DNA duplex. As a result of the processing, the DNA sequence between the two repeats is deleted. The length of the deletion can depend on many factors including the location of the two repeats utilized, and the pathway or processivity of the resection.

In contrast to HDR pathways, SSA does not require a template nucleic acid to alter or correct a target nucleic acid sequence. Instead, the complementary repeat sequence is utilized.

Other DNA Repair Pathways

SSBR (Single Strand Break Repair)

Single-stranded breaks (SSB) in the genome are repaired by the SSBR pathway, which is a distinct mechanism from the DSB repair mechanisms discussed above. The SSBR pathway has four major stages: SSB detection, DNA end processing, DNA gap filling, and DNA ligation. A more detailed explanation is given in Caldecott, Nature Reviews Genetics 9, 619-631 (August 2008), and a summary is given here.

In the first stage, when a SSB forms, PARP1 and/or PARP2 recognize the break and recruit repair machinery. The binding and activity of PARP1 at DNA breaks is transient and it seems to accelerate SSBr by promoting the focal accumulation or stability of SSBr protein complexes at the lesion. Arguably the most important of these SSBr proteins is XRCC1, which functions as a molecular scaffold that interacts with, stabilizes, and stimulates multiple enzymatic components of the SSBr process including the protein responsible for cleaning the DNA 3' and 5' ends. For instance, XRCC1 interacts with several proteins (DNA polymerase beta, PNK, and three nucleases, APE1, APTX, and APLF) that promote end processing. APE1 has endonuclease activity. APLF exhibits endonuclease and 3' to 5' exonuclease activities. APTX has endonuclease and 3' to 5' exonuclease activity.

This end processing is an important stage of SSBR since the 3'- and/or 5'-termini of most, if not all, SSBs are 'damaged'. End processing generally involves restoring a damaged 3'-end to a hydroxylated state and and/or a damaged 5' end to a phosphate moiety, so that the ends become ligation-competent. Enzymes that can process damaged 3' termini include PNKP, APE1, and TDP1. Enzymes that can process damaged 5' termini include PNKP, DNA polymerase beta, and APTX. LIG3 (DNA ligase III) can also participate in end processing. Once the ends are cleaned, gap filling can occur.

At the DNA gap filling stage, the proteins typically present are PARP1, DNA polymerase beta, XRCC1, FEN1 (flap endonuclease 1), DNA polymerase delta/epsilon, PCNA, and LIG1. There are two ways of gap filling, the short patch repair and the long patch repair. Short patch repair involves the insertion of a single nucleotide that is missing. At some SSBs, "gap filling" might continue displacing two or more nucleotides (displacement of up to 12 bases have been reported). FEN1 is an endonuclease that removes the displaced 5'-residues. Multiple DNA polymerases, including Pol β, are involved in the repair of SSBs, with the choice of DNA polymerase influenced by the source and type of SSB.

In the fourth stage, a DNA ligase such as LIG1 (Ligase I) or LIG3 (Ligase III) catalyzes joining of the ends. Short patch repair uses Ligase III and long patch repair uses Ligase I.

Sometimes, SSBR is replication-coupled. This pathway can involve one or more of CtIP, MRN, ERCC1, and FEN1. Additional factors that may promote SSBR include: aPARP, PARP1, PARP2, PARG, XRCC1, DNA polymerase b, DNA polymerase d, DNA polymerase e, PCNA, LIG1, PNK, PNKP, APE1, APTX, APLF, TDP1, LIG3, FEN1, CtIP, MRN, and ERCC1.

MMR (Mismatch Repair)

Cells contain three excision repair pathways: MMR, BER, and NER. The excision repair pathways have a common feature in that they typically recognize a lesion on one strand of the DNA, then exo/endonucleases remove the lesion and leave a 1-30 nucleotide gap that is sub-sequentially filled in by DNA polymerase and finally sealed with ligase. A more complete picture is given in Li 2008, and a summary is provided here.

Mismatch repair (MMR) operates on mispaired DNA bases.

The MSH2/6 or MSH2/3 complexes both have ATPases activity that plays an important role in mismatch recognition and the initiation of repair. MSH2/6 preferentially recognizes base-base mismatches and identifies mispairs of 1 or 2 nucleotides, while MSH2/3 preferentially recognizes larger ID mispairs.

hMLH1 heterodimerizes with hPMS2 to form hMutLα which possesses an ATPase activity and is important for multiple steps of MMR. It possesses a PCNA/replication factor C (RFC)-dependent endonuclease activity which plays an important role in 3' nick-directed MMR involving EXO1 (EXO1 is a participant in both HR and MMR). It regulates termination of mismatch-provoked excision. Ligase I is the relevant ligase for this pathway. Additional factors that may promote MMR include: EXO1, MSH2, MSH3, MSH6, MLH1, PMS2, MLH3, DNA Pol d, RPA, HMGB1, RFC, and DNA ligase I.

Base Excision Repair (BER)

The base excision repair (BER) pathway is active throughout the cell cycle; it is responsible primarily for removing small, non-helix-distorting base lesions from the genome. In contrast, the related Nucleotide Excision Repair pathway (discussed in the next section) repairs bulky helix-distorting lesions. A more detailed explanation is given in Caldecott, Nature Reviews Genetics 9, 619-631 (August 2008), and a summary is given here.

Upon DNA base damage, base excision repair (BER) is initiated and the process can be simplified into five major steps: (a) removal of the damaged DNA base; (b) incision of the subsequent a basic site; (c) clean-up of the DNA ends; (d) insertion of the correct nucleotide into the repair gap; and (e) ligation of the remaining nick in the DNA backbone. These last steps are similar to the SSBR.

In the first step, a damage-specific DNA glycosylase excises the damaged base through cleavage of the N-glycosidic bond linking the base to the sugar phosphate backbone. Then AP endonuclease-1 (APE1) or bifunctional DNA glycosylases with an associated lyase activity incised the phosphodiester backbone to create a DNA single strand break (SSB). The third step of BER involves cleaning-up of the DNA ends. The fourth step in BER is conducted by Pol β that adds a new complementary nucleotide into the repair gap and in the final step XRCC1/Ligase III seals the remaining nick in the DNA backbone. This completes the short-patch BER pathway in which the majority (~80%) of damaged DNA bases are repaired. However, if the 5'-ends in step 3 are resistant to end processing activity, following one nucleotide insertion by Pol β there is then a polymerase switch to the replicative DNA polymerases, Pol δ/ε, which then add ~2-8 more nucleotides into the DNA repair gap. This creates a 5'-flap structure, which is recognized and excised by flap endonuclease-1 (FEN-1) in association with the processivity factor proliferating cell nuclear antigen (PCNA). DNA ligase I then seals the remaining nick in the DNA backbone and completes long-patch BER. Additional factors that may promote the BER pathway include: DNA glycosylase, APE1, Polb, Pold, Pole, XRCC1, Ligase III, FEN-1, PCNA, RECQL4, WRN, MYH, PNKP, and APTX.

Nucleotide Excision Repair (NER)

Nucleotide excision repair (NER) is an important excision mechanism that removes bulky helix-distorting lesions from DNA. Additional details about NER are given in Marteijn 2014, and a summary is given here. NER a broad pathway encompassing two smaller pathways: global genomic NER (GG-NER) and transcription coupled repair NER (TC-NER). GG-NER and TC-NER use different factors for recognizing DNA damage. However, they utilize the same machinery for lesion incision, repair, and ligation.

Once damage is recognized, the cell removes a short single-stranded DNA segment that contains the lesion. Endonucleases XPF/ERCC1 and XPG (encoded by ERCC5) remove the lesion by cutting the damaged strand on either side of the lesion, resulting in a single-strand gap of 22-30 nucleotides. Next, the cell performs DNA gap filling synthesis and ligation. Involved in this process are: PCNA, RFC, DNA Pol δ, DNA Pol ε or DNA Pol κ, and DNA ligase I or XRCC1/Ligase III. Replicating cells tend to use DNA pol c and DNA ligase I, while non-replicating cells tend to use DNA Pol δ, DNA Pol κ, and the XRCC1/Ligase III complex to perform the ligation step.

NER can involve the following factors: XPA-G, POLH, XPF, ERCC1, XPA-G, and LIG1. Transcription-coupled NER (TC-NER) can involve the following factors: CSA, CSB, XPB, XPD, XPG, ERCC1, and TTDA. Additional factors that may promote the NER repair pathway include XPA-G, POLH, XPF, ERCC1, XPA-G, LIG1, CSA, CSB, XPA, XPB, XPC, XPD, XPF, XPG, TTDA, UVSSA, USP7, CETN2, RAD23B, UV-DDB, CAK subcomplex, RPA, and PCNA.

Interstrand Crosslink (ICL)

A dedicated pathway called the ICL repair pathway repairs interstrand crosslinks. Interstrand crosslinks, or covalent crosslinks between bases in different DNA strand, can occur during replication or transcription. ICL repair involves the coordination of multiple repair processes, in particular, nucleolytic activity, translesion synthesis (TLS), and HDR. Nucleases are recruited to excise the ICL on either side of the crosslinked bases, while TLS and HDR are coordinated to repair the cut strands. ICL repair can involve the following factors: endonucleases, e.g., XPF and RAD51C, endonucleases such as RAD51, translesion polymerases, e.g., DNA polymerase zeta and Rev1), and the Fanconi anemia (FA) proteins, e.g., FancJ.

Other Pathways

Several other DNA repair pathways exist in mammals.

Translesion synthesis (TLS) is a pathway for repairing a single stranded break left after a defective replication event and involves translesion polymerases, e.g., DNA pol☐ and Rev1.

Error-free postreplication repair (PRR) is another pathway for repairing a single stranded break left after a defective replication event.

Examples of gRNAs in Genome Editing Methods gRNA molecules as described herein can be used with Cas9 molecules that cleave both or a single strand to alter the sequence of a target nucleic acid, e.g., of a target position or target genetic signature. gRNA molecules useful in these method are described below.

In an embodiment, the gRNA, e.g., a chimeric gRNA, molecule is configured such that it comprises one or more of the following properties;

a) it can position, e.g., when targeting a Cas9 molecule that makes double strand breaks, a double strand break (i) within 50, 100, 150 or 200 nucleotides of a target position, or (ii) sufficiently close that the target position is within the region of end resection;

b) it has a targeting domain of at least 17 nucleotides, e.g., a targeting domain of (i) 17, (ii) 18, or (iii) 20 nucleotides; and c)

(i) the proximal and tail domain, when taken together, comprise at least 15, 18, 20, 25, 30, 31, 35, 40, 45, 49, 50, or 53 nucleotides, e.g., at least 15, 18, 20, 25, 30, 31, 35, 40, 45, 49, 50, or 53 nucleotides from a naturally occurring *S. pyogenes, S. thermophilus, S. aureus*, or *N. meningitidis* tail and proximal domain, or a sequence that differs by no more than 1, 2, 3, 4, 5; 6, 7, 8, 9 or 10 nucleotides therefrom;

(ii) there are at least 15, 18, 20, 25, 30, 31, 35, 40, 45, 49, 50, or 53 nucleotides 3' to the last nucleotide of the second complementarity domain, e.g., at least 15, 18, 20, 25, 30, 31, 35, 40, 45, 49, 50, or 53 nucleotides from the corresponding sequence of a naturally occurring *S. pyogenes, S. thermophilus, S. aureus*, or *N. meningitidis* gRNA, or a sequence that differs by no more than 1, 2, 3, 4, 5; 6, 7, 8, 9 or 10 nucleotides therefrom;

(iii) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain, e.g., at least 16, 19, 21, 26, 31, 32, 36, 41, 46, 50, 51, or 54 nucleotides from the corresponding sequence of a naturally occurring *S. pyogenes, S. thermophilus, S. aureus*, or *N. meningitidis* gRNA, or a sequence that differs by no more than 1, 2, 3, 4, 5, 6, 7, 8, 9 or 10 nucleotides therefrom;

iv) the tail domain is at least 10, 15, 20, 25, 30, 35 or 40 nucleotides in length, e.g., it comprises at least 10, 15, 20, 25, 30, 35 or 40 nucleotides from a naturally occurring *S. pyogenes, S. thermophilus, S. aureus*, or *N. meningitidis* tail domain; or, a sequence that differs by no more than 1, 2, 3, 4, 5, 6, 7, 8, 9 or 10 nucleotides therefrom; or (v) the tail domain comprises 15, 20, 25, 30, 35, 40 nucleotides or all of the corresponding portions of a naturally occurring tail domain, e.g., a naturally occurring *S. pyogenes, S. thermophilus, S. aureus*, or *N. meningitidis* tail domain.

In an embodiment, the gRNA molecule is configured such that it comprises properties: a(i); and b(i).

In an embodiment, the gRNA molecule is configured such that it comprises properties: a(i); and b(ii).

In an embodiment, the gRNA molecule is configured such that it comprises properties: a(i); and b(iii).

In an embodiment, the gRNA molecule is configured such that it comprises properties: a(ii); and b(i).

In an embodiment, the gRNA molecule is configured such that it comprises properties: a(ii); and b(ii).

In an embodiment, the gRNA molecule is configured such that it comprises properties: a(ii); and b(iii).

In an embodiment, the gRNA molecule is configured such that it comprises properties: b(i); and c(i).

In an embodiment, the gRNA molecule is configured such that it comprises properties: b(i); and c(ii).

In an embodiment, the gRNA molecule is configured such that it comprises properties: b(ii); and c(i).

In an embodiment, the gRNA molecule is configured such that it comprises properties: b(ii); and c(ii).

In an embodiment, the gRNA molecule is configured such that it comprises properties: b(iii); and c(i).

In an embodiment, the gRNA molecule is configured such that it comprises properties: b(iii); and c(ii).

In an embodiment, the gRNA is used with a Cas9 nickase molecule having HNH activity, e.g., a Cas9 molecule having the RuvC activity inactivated, e.g., a Cas9 molecule having a mutation at D10, e.g., the D10A mutation.

In an embodiment, the gRNA is used with a Cas9 nickase molecule having RuvC activity, e.g., a Cas9 molecule having the HNH activity inactivated, e.g., a Cas9 molecule having a mutation at H840, e.g., a H840A.

In an embodiment, the gRNA is used with a Cas9 nickase molecule having RuvC activity, e.g., a Cas9 molecule having the HNH activity inactivated, e.g., a Cas9 molecule having a mutation at H863, e.g., a H863A.

In an embodiment, a pair of gRNA molecules, e.g., a pair of chimeric gRNA molecules, comprising a first and a second gRNA molecule, is configured such that they comprises one or more of the following properties:

a) the first and second gRNA molecules position, e.g., when targeting a Cas9 molecule that makes single strand or double strand breaks:

(i) as positioned by a first and second gRNA molecule described herein; or (ii) sufficiently close that the target position is altered when the break is repaired;

b) one or both, independently, has a targeting domain of at least 17 nucleotides, e.g., a targeting domain of (i) 17, (ii) 18, or (iii) 20 nucleotides; and c) one or both, independently, has a the tail domain is (i) at least 10, 15, 20, 25, 30, 35 or 40 nucleotides in length or (ii) the tail domain comprises, 15, 20, 25, 30, 35, 40, or all of the corresponding portions of a naturally occurring tail domain, e.g., a naturally occurring *S. pyogenes, S. aureus*, or *S. thermophilus* tail domain.

In an embodiment, one or both of the gRNA molecules is configured such that it comprises properties: a(i); and b(i).

In an embodiment, one or both of the gRNA molecules is configured such that it comprises properties: a(i); and b(ii).

In an embodiment, one or both of the gRNA molecules is configured such that it comprises properties: a(i); and b(iii).

In an embodiment, one or both of the gRNA molecules is configured such that it comprises properties: a(ii); and b(i).

In an embodiment, one or both of the gRNA molecules is configured such that it comprises properties: a(ii); and b(ii).

In an embodiment, one or both of the gRNA molecules is configured such that it comprises properties: a(ii); and b(iii).

In an embodiment, one or both of the gRNA molecules is configured such that it comprises properties: b(i); and c(i).

In an embodiment, one or both of the gRNA molecules is configured such that it comprises properties: b(i); and c(ii).

In an embodiment, one or both of the gRNA molecules is configured such that it comprises properties: b(ii); and c(i).

In an embodiment, one or both of the gRNA molecules is configured such that it comprises properties: b(ii); and c(ii).

In an embodiment, one or both of the gRNA molecules is configured such that it comprises properties: b(iii); and c(i).

In an embodiment, one or both of the gRNA molecules is configured such that it comprises properties: b(iii); and c(ii).

In an embodiment, one or both of the gRNA molecules is configured such that it comprises properties: b(iii); and c(ii).

In an embodiment the gRNA is used with a Cas9 nickase molecule having HNH activity, e.g., a Cas9 molecule having the RuvC activity inactivated, e.g., a Cas9 molecule having a mutation at D10, e.g., the D10A mutation.

In an embodiment, the gRNA is used with a Cas9 nickase molecule having RuvC activity, e.g., a Cas9 molecule having the HNH activity inactivated, e.g., a Cas9 molecule having a mutation at H840, e.g., a H840A.

In an embodiment the gRNA is used with a Cas9 nickase molecule having RuvC activity, e.g., a Cas9 molecule having the HNH activity inactivated, e.g., a Cas9 molecule having a mutation at H863, e.g., a H863A.

Targets: Cells

Cas9 molecules and gRNA molecules, e.g., a Cas9 molecule/gRNA molecule complex, can be used to manipulate a cell, e.g., to edit a target nucleic acid, in a wide variety of cells.

In some embodiments, a cell is manipulated by altering one or more target genes, e.g., as described herein. In some embodiments, the expression of one or more target genes (e.g., one or more target genes described herein) is modulated, e.g., in vivo.

In an embodiment, the target cell is a retinal cell, e.g., a cell of the retinal pigment epithelium cell or a photoreceptor cell. In another embodiment, the target cell is a horizontal cell, a bipolar cell, an amacrine cell, or a ganglion cell. In an embodiment, the target cell is a cone photoreceptor cell or cone cell, a rod photoreceptor cell or rod cell, or a macular cone photoreceptor cell. In an exemplary embodiment, cone photoreceptors in the macula are targeted, i.e., cone photoreceptors in the macula are the target cells.

In an embodiment, the target cell is removed from the subject, the gene altered ex vivo, and the cell returned to the subject. In an embodiment, a photoreceptor cell is removed from the subject, the gene altered ex vivo, and the photoreceptor cell returned to the subject. In an embodiment, a cone photoreceptor cell is removed from the subject, the gene altered ex vivo, and the cone photoreceptor cell returned to the subject.

In an embodiment, the cells are induced pluripotent stem cells (iPS) cells or cells derived from iPS cells, e.g., iPS cells from the subject, modified to alter the gene and differentiated into retinal progenitor cells or retinal cells, e.g., retinal photoreceptors, and injected into the eye of the subject, e.g., subretinally, e.g., in the submacular region of the retina.

In an embodiment, the cells are targeted in vivo, e.g., by delivery of the components, e.g., a Cas9 molecule and a gRNA molecule, to the target cells. In an embodiment, the target cells are retinal pigment epithelium, photoreceptor cells, or a combination thereof. In an embodiment, AAV is used to deliver the components, e.g., a Cas9 molecule and a gRNA molecule, e.g., by transducing the target cells.

VII. Delivery, Formulations and Routes of Administration

The components, e.g., a Cas9 molecule and gRNA molecule can be delivered, formulated, or administered in a variety of forms, see, e.g., Table 18. In an embodiment, one Cas9 molecule and two or more (e.g., 2, 3, 4, or more) different gRNA molecules are delivered, e.g., by an AAV vector. In an embodiment, the sequence encoding the Cas9 molecule and the sequence(s) encoding the two or more (e.g., 2, 3, 4, or more) different gRNA molecules are present on the same nucleic acid molecule, e.g., an AAV vector. When a Cas9 or gRNA component is delivered encoded in DNA the DNA will typically include a control region, e.g., comprising a promoter, to effect expression. Useful promoters for Cas9 molecule sequences include CMV, EFS, EF-1α, MSCV, PGK, CAG, hGRK1, hCRX, hNRL, and hRCVRN control promoters. In an embodiment, the promoter is a constitutive promoter. In another embodiment, the promoter is a tissue specific promoter. Exemplary promoter sequences are disclosed in Table 20. Useful promoters for gRNAs include H1, 7SK, and U6 promoters. Promoters with similar or dissimilar strengths can be selected to tune the expression of components. Sequences encoding a Cas9 molecule can comprise a nuclear localization signal (NLS), e.g., an SV40 NLS. In an embodiment, the sequence encoding a Cas9 molecule comprises at least two nuclear localization signals. In an embodiment a promoter for a Cas9 molecule or a gRNA molecule can be, independently, inducible, tissue specific, or cell specific. To detect the expression of a Cas9, an affinity tag can be used. Useful affinity tag sequences include, but are not limited to, 3×Flag tag, single Flag tag, HA tag, Myc tag or HIS tag. Exemplary affinity tag sequences are disclosed in Table 26. To regulate Cas9 expression, e.g., in mammalian cells, polyadenylation signals (poly(A) signals) can be used. Exemplary polyadenylation signals are disclosed in Table 27.

Table 18 provides examples of how the components can be formulated, delivered, or administered.

TABLE 18

| Elements | | |
| --- | --- | --- |
| Cas9 Molecule(s) | gRNA molecule(s) | Comments |
| DNA | DNA | In this embodiment a Cas9 molecule, typically an eaCas9 molecule, and a gRNA are transcribed from DNA. In this embodiment they are encoded on separate molecules. |
|  | DNA | In this embodiment a Cas9 molecule, typically an eaCas9 molecule, and a gRNA are transcribed from DNA, here from a single molecule. |
| DNA | RNA | In this embodiment a Cas9 molecule, typically an eaCas9 molecule, is transcribed from DNA. |
| mRNA | RNA | In this embodiment a Cas9 molecule, typically an eaCas9 molecule, is transcribed from DNA. |
| Protein | DNA | In this embodiment a Cas9 molecule, typically an eaCas9 molecule, is provided as a protein. A gRNA is transcribed from DNA. |
| Protein | RNA | In this embodiment an eaCas9 molecule is provided as a protein. |

Table 19 summarizes various delivery methods for the components of a Cas system, e.g., the Cas9 molecule component and the gRNA molecule component, as described herein.

TABLE 19

| Delivery Vector/Mode | | Delivery into Non-Dividing Cells | Duration of Expression | Genome Integration | Type of Molecule Delivered |
|---|---|---|---|---|---|
| Physical (e.g., electroporation, particle gun, Calcium Phosphate transfection) | | YES | Transient | NO | Nucleic Acids and Proteins |
| Viral | Retrovirus | NO | Stable | YES | RNA |
| | Lentivirus | YES | Stable | YES/NO with modifications | RNA |
| | Adenovirus | YES | Transient | NO | DNA |
| | Adeno-Associated Virus (AAV) | YES | Stable | NO | DNA |
| | Vaccinia Virus | YES | Very Transient | NO | DNA |
| | Herpes Simplex Virus | YES | Stable | NO | DNA |
| Non-Viral | Cationic Liposomes | YES | Transient | Depends on what is delivered | Nucleic Acids and Proteins |
| | Polymeric Nanoparticles | YES | Transient | Depends on what is delivered | Nucleic Acids and Proteins |
| Biological Non-Viral Delivery Vehicles | Attenuated Bacteria | YES | Transient | NO | Nucleic Acids |
| | Engineered Bacteriophages | YES | Transient | NO | Nucleic Acids |
| | Mammalian Virus-like Particles | YES | Transient | NO | Nucleic Acids |
| | Biological liposomes: Erythrocyte Ghosts and Exosomes | YES | Transient | NO | Nucleic Acids |

Table 20 describes exemplary promoter sequences that can be used in AAV vectors, e.g., for Cas9 expression.

TABLE 20

Cas9 Promoter Sequences

| Promoter | Length (bp) | DNA Sequence |
|---|---|---|
| CMV | 617 | SEQ ID NO: 401 |
| EFS | 252 | SEQ ID NO: 402 |
| Human GRK1 (rhodopsin kinase) | 292 | SEQ ID NO: 403 |
| Human CRX (cone rod homeobox transcription factor) | 113 | SEQ ID NO: 404 |
| Human NRL (neural retina leucine zipper transcription factor enhance upstream of the human TK terminal promoter) | 281 | SEQ ID NO: 405 |
| Human RCVRN (recoverin) | 235 | SEQ ID NO: 406 |

Table 26 describes exemplary affinity tag sequences that can be used in AAV vectors, e.g., for Cas9 expression.

TABLE 26

| Affinity tag | Amino Acid Sequence |
|---|---|
| 3XFlag tag | DYKDHDGDYKDHDIDYKDDDDK (SEQ ID NO: 426) |
| Flag tag (single) | DYKDDDDK (SEQ ID NO: 451) |

TABLE 26-continued

| Affinity tag | Amino Acid Sequence |
|---|---|
| HA tag | YPYDVPDYA (SEQ ID NO: 452) |
| Myc tag | EQKLISEEDL (SEQ ID NO: 453) |
| HIS tag | HEIHHHH (SEQ ID NO: 454) |

Table 27 describes exemplary polyadenylation (polyA) sequences that can be used in AAV vectors, e.g., for Cas9 expression.

TABLE 27

Exemplary PolyA Sequences

| PolyA | DNA sequence |
|---|---|
| Mini polyA | SEQ ID NO: 424 |
| bGH polyA | SEQ ID NO: 455 |
| SV40 polyA | SEQ ID NO: 456 |

Table 25 describes exemplary Inverted Terminal Repeat (ITR) sequences that can be used in AAV vectors.

TABLE 25

Sequences of ITRs from Exemplary AAV Serotypes

| AAV Serotype | Left ITR Sequence | Right ITR Sequence |
| --- | --- | --- |
| AAV1 | SEQ ID NO: 407 | SEQ ID NO: 436 |
| AAV2 | SEQ ID NO: 408 | SEQ ID NO: 437 |
| AAV3B | SEQ ID NO: 409 | SEQ ID NO: 438 |
| AAV4 | SEQ ID NO: 410 | SEQ ID NO: 439 |
| AAV5 | SEQ ID NO: 411 | SEQ ID NO: 440 |
| AAV6 | SEQ ID NO: 412 | SEQ ID NO: 441 |
| AAV7 | SEQ ID NO: 413 | SEQ ID NO: 442 |
| AAV8 | SEQ ID NO: 414 | SEQ ID NO: 443 |
| AAV9 | SEQ ID NO: 415 | SEQ ID NO: 444 |

Additional exemplary sequences for the recombinant AAV genome components described herein are provided below.

Exemplary left and right ITR sequences are provided in Table 25 (SEQ ID NOs: 407-415 and 436-444).

Exemplary spacer 1 sequence: CAGATCTGAAT-TCGGTACC (SEQ ID NO: 416).

Exemplary U6 promoter sequence:

(SEQ ID NO: 417)
AAGGTCGGGCAGGAAGAGGGCCTATTTCCCATGATTCCTTCATATTTGCA

TATACGATACAAGGCTGTTAGAGAGATAATTAGAATTAATTTGACTGTAA

ACACAAAGATATTAGTACAAAATACGTGACGTAGAAAGTAATAATTTCTT

GGGTAGTTTGCAGTTTTAAAATTATGTTTTAAAATGGACTATCATATGCT

TACCGTAACTTGAAAGTATTTCGATTTCTTGGCTTTATATATCTTGTGGA

AAGGACGAAACACC

Exemplary gRNA targeting domain sequences are described herein, e.g., in Tables 2A-2D, Tables 3A-3C, Tables 4A-4D, Tables 5A-5D, Tables 6A-6B, Tables 7A-7D, Tables 8A-8D, Tables 9A-9E, Tables 10A-10B, or Table 11.

Exemplary gRNA scaffold domain sequence:

(SEQ ID NO: 418)
GTTTTAGTACTCTGGAAACAGAATCTACTAAAACAAGGCAAAATGCCGTG

TTTATCTCGTCAACTTGTTGGCGAGATTTTTT.

Exemplary spacer 2 domain sequence:

(SEQ ID NO: 419)
GGTACCGCTAGCGCTTAAGTCGCGATGTACGGGCCAGATATACGCGTTG
A.

Exemplary Polymerase II promoter sequences are provided in Table 20.

Exemplary N-ter NLS nucleotide sequence:

(SEQ ID NO: 420)
CCGAAGAAAAAGCGCAAGGTCGAAGCGTCC

Exemplary N-ter NLS amino acid sequence: PKKKRKV (SEQ ID NO: 434)

Exemplary S. aureus Cas9 nucleotide sequence set forth in SEQ ID NO: 39.

Exemplary S. aureus Cas9 amino acid sequence set forth in SEQ ID NO: 26.

Exemplary C-ter NLS sequence: CCCAAGAAGAAGAGGAAAGTC (SEQ ID NO: 422).

Exemplary C-ter NLS amino acid sequence: PKKKRKV (SEQ ID NO: 434)

Exemplary poly(A) signal sequence:

(SEQ ID NO: 424)
TAGCAATAAAGGATCGTTTATTTTCATTGGAAGCGTGTGTTGGTTTTTTG

ATCAGGCGCG.

Exemplary Spacer 3 sequence:

(SEQ ID NO: 425)
TCCAAGCTTCGCAGGAAAGAACATGTGAGCAAAAGGCCAGCAAAAGGCGT

TAACTCTAGATTTAAATGCATGCTGGGGAGAGATCT

Exemplary 3xFLAG nucleotide sequence:

(SEQ ID NO: 423)
GACTACAAAGACCATGACGGTGATTATAAAGATCATGACATCGATTACAA

GGATGACGATGACAAG.

Exemplary 3xFLAG amino acid sequence:

(SEQ ID NO: 426)
DYKDHDGDYKDHDIDYKDDDDK

Exemplary Spacer 4 sequence: CGACTTAGTTC-GATCGAAGG (SEQ ID NO: 427).

Exemplary recombinant AAV genome sequences are provided in FIGS. 19A-24F (SEQ ID NOs: 428-433 and 445-450). Exemplary sequences of the recombinant AAV genome components (e.g., one or more of the components described above) are also shown in FIGS. 19A-24F (SEQ ID NOs: 428-433 and 445-450).

Figure 25A:
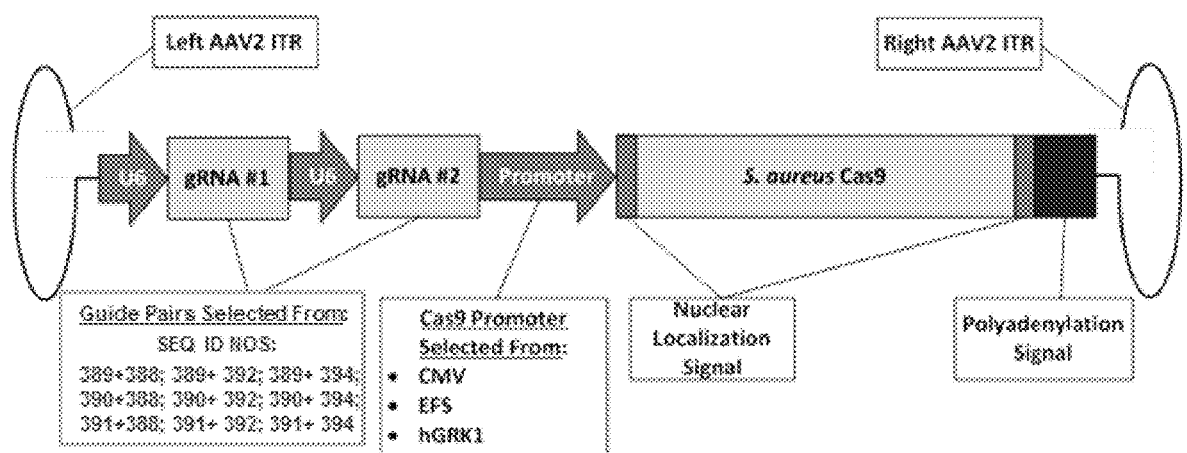
FIGS. 25A-C include schematic depictions of exemplary AAV viral genome according to certain embodiments of the disclosure.

In certain aspects, the present disclosure focuses on AAV vectors encoding CRISPR/Cas9 genome editing systems, and on the use of such vectors to treat CEP290 associated disease. Exemplary AAV vector genomes are schematized in FIGS. 25A through 25C, which illustrate certain fixed and variable elements of these vectors: inverted terminal repeats (ITRs), one or two gRNA sequences and promoter sequences to drive their expression, a Cas9 coding sequence and another promoter to drive its expression. Each of these elements is discussed in detail below.

Turning first to the gRNA pairs utilized in the nucleic acids or AAV vectors of the present disclosure, one of three "left" or "upstream" guides may be used to cut upstream (between exon 26 and the IVS26 mutation), and one of three "right" or "downstream" guides is used to cut downstream (between the IVS26 mutation and exon 27). Targeting domain sequences of these guides (both DNA and RNA sequences) are presented in Table 28, below:

TABLE 28

Upstream (left) and Downstream (right) gRNA Targeting Domain Sequences

| SEQ ID NO: | DNA | SEQ ID NO: | RNA |
|---|---|---|---|
| *Upstream (left) guides* | | | |
| 389 | GTTCTGTCCTCAGTAAAAGGTA | 530 | GUUCUGUCCUCAGUAAAAGGUA |
| 390 | GAATAGTTTGTTCTGGGTAC | 468 | GAAUAGUUUGUUCUGGGUAC |
| 391 | GAGAAAGGGATGGGCACTTA | 538 | GAGAAAGGGAUGGGCACUUA |
| *Downstream (right) guides* | | | |
| 388 | GTCAAAAGCTACCGGTTACCTG | 558 | GUCAAAAGCUACCGGUUACCUG |
| 392 | GATGCAGAACTAGTGTAGAC | 460 | GAUGCAGAACUAGUGUAGAC |
| 394 | GAGTATCTCCTGTTTGGCA | 568 | GAGUAUCUCCUGUUUGGCA |

The left and right guides can be used in any combination, though certain combinations may be more suitable for certain applications. Table 29 sets forth several upstream+downstream guide pairs used in the embodiments of this disclosure. It should be noted, notwithstanding the use of "left" and "right" as nomenclature for gRNAs, that any guide in a pair, upstream or downstream, may be placed in either one of the gRNA coding sequence positions illustrated in FIG. 25.

TABLE 29

Upstream (Left) + Downstream (Right) Guide Pairs by SEQ ID NO.

| | | Downstream | | |
|---|---|---|---|---|
| | | 388 | 392 | 394 |
| Upstream | 389 | 389 + 388 | 389 + 392 | 389 + 394 |
| | 390 | 390 + 388 | 390 + 392 | 390 + 394 |
| | 391 | 391 + 388 | 391 + 392 | 391 + 394 |
| | | Downstream | | |
| | | 558 | 460 | 568 |
| Upstream | 530 | 530 + 558 | 530 + 460 | 530 + 568 |
| | 468 | 468 + 558 | 468 + 460 | 468 + 568 |
| | 538 | 538 + 558 | 538 + 460 | 538 + 568 |

In some embodiments, the gRNAs used in the present disclosure are derived from *S. aureus* gRNAs and can be unimolecular or modular, as described below. An exemplary unimolecular *S. aureus* gRNA is shown in FIG. 18B, and exemplary DNA and RNA sequences corresponding to unimolecular *S. aureus* gRNAs are shown below:

DNA:
(SEQ ID NO: 2785)
[N]$_{16-24}$GTTTTAGTACTCTGGAAACAGAATCTACTAAAACAAGGCAAA

ATGCCGTGTTTATCTCGTCAACTTGTTGGCGAGATTTTTT
and

RNA:
(SEQ ID NO: 2779)
[N]$_{16-24}$GUUUUAGUACUCUGGAAACAGAAUCUACUAAAACAAGGCAAA

AUGCCGUGUUUAUCUCGUCAACUUGUUGGCGAGA.

DNA:
(SEQ ID NO: 2787)
[N]$_{16-24}$GTTATAGTACTCTGGAAACAGAATCTACTATAACAAGGCAAA

ATGCCGTGTTTATCTCGTCAACTTGTTGGCGAGATTTTTT
and

RNA:
(SEQ ID NO: 2786)
[N]$_{16-24}$GUUAUAGUACUCUGGAAACAGAAUCUACUAUAACAAGGCAAA

AUGCCGUGUUUAUCUCGUCAACUUGUUGGCGAGA.

It should be noted that, while the figure depicts a targeting domain of 20 nucleotides, the targeting domain can have any suitable length. gRNAs used in the various embodiments of this disclosure preferably include targeting domains of between 16 and 24 (inclusive) bases in length at their 5' ends, and optionally include a 3' U6 termination sequence as illustrated.

The gRNA in FIG. 18B is depicted as unimolecular, but in some instances modular guides can be used. In the exemplary unimolecular gRNA sequences above, a 5' portion corresponding to a crRNA (underlined) is connected by a GAAA linker to a 3' portion corresponding to a tracrRNA (double underlined). Skilled artisans will appreciate that two-part modular gRNAs can be used that correspond to the underlined and double underlined sections.

Either one of the gRNAs presented above can be used with any of targeting sequences SEQ ID NOs: 389-391, 388, 392, or 394, and two gRNAs in a pair do not necessarily include the same backbone sequence. Additionally, skilled artisans will appreciate that the exemplary gRNA designs set forth herein can be modified in a variety of ways, which are described below or are known in the art; the incorporation of such modifications is within the scope of this disclosure.

Expression of each of the gRNAs in the AAV vector is driven by a pair of U6 promoters, such as a human U6 promoter. An exemplary U6 promoter sequence, as set forth in Maeder, is SEQ ID NO: 417.

Turning next to Cas9, in some embodiments the Cas9 protein is S. aureus Cas9. In further embodiments of this disclosure an S. aureus Cas9 sequence is modified to include two nuclear localization sequences (NLSs) at the C- and N-termini of the Cas9 protein, and a mini-polyadenylation signal (or Poly-A sequence). Exemplary S. aureus Cas9 sequences are provided as SEQ ID NO: 39 (i.e., codon-optimized S. aureus Cas9 nucleotide sequence) and SEQ ID NO: 26 (i.e., S. aureus Cas9 protein sequence). These sequences are exemplary in nature, and are not intended to be limiting. The skilled artisan will appreciate that modifications of these sequences may be possible or desirable in certain applications; such modifications are described below, or are known in the art, and are within the scope of this disclosure.

Skilled artisans will also appreciate that polyadenylation signals are widely used and known in the art, and that any suitable polyadenylation signal can be used in the embodiments of this disclosure. One exemplary polyadenylation signal is set forth in SEQ ID NO: 424.

Cas9 expression is driven, in certain vectors of this disclosure, by one of three promoters: cytomegalovirus (CMV) (i.e., SEQ ID NO: 401), elongation factor-1 (EFS) (i.e., SEQ ID NO: 402), or human g-protein receptor coupled kinase-1 (hGRK1) (i.e., SEQ ID NO: 403), which is specifically expressed in retinal photoreceptor cells. Modifications of the sequences of the promoters may be possible or desirable in certain applications, and such modifications are within the scope of this disclosure.

AAV genomes according to the present disclosure generally incorporate inverted terminal repeats (ITRs) derived from the AAV2 serotype. Exemplary left and right ITRs are SEQ ID NO: 408 (AAV2 Left ITR) and SEQ ID NO: 437 (AAV2 Right ITR), respectively. It should be noted, however, that numerous modified versions of the AAV2 ITRs are used in the field, and the ITR sequences shown below are exemplary and are not intended to be limiting. Modifications of these sequences are known in the art, or will be evident to skilled artisans, and are thus included in the scope of this disclosure.

As FIG. 25 illustrates, the gRNA pairs and the Cas9 promoter are variable and can be selected from the lists presented above. For clarity, this disclosure encompasses nucleic acids and/or AAV vectors comprising any combination of these elements, though certain combinations may be preferred for certain applications. Accordingly, in various embodiments of this disclosure, a nucleic acid or AAV vector encodes a CMV promoter for the Cas9, and gRNAs comprising targeting domains according to SEQ ID NOs: 389 and 388 (RNA sequences are SEQ ID NOs: 530 and 558, respectively); a CMV promoter and gRNAs comprising targeting domains according to SEQ ID NOs: 389 and 392 (RNA sequences are SEQ ID NOs: 530 and 460, respectively); a CMV promoter and gRNAs comprising targeting domains according to SEQ ID NOs: 389 and 394 (RNA sequences are SEQ ID NOs: 530 and 568, respectively); a CMV promoter and gRNAs comprising targeting domains according to SEQ ID NOs: 390 and 388 (RNA sequences are SEQ ID NOs: 468 and 558, respectively); a CMV promoter and gRNAs comprising targeting domains according to SEQ ID NOs: 390 and 392 (RNA sequences are SEQ ID NOs: 468 and 460, respectively); a CMV promoter and gRNAs comprising targeting domains according to SEQ ID NOs: 390 and 394 (RNA sequences are SEQ ID NOs: 468 and 568, respectively); a CMV promoter and gRNAs comprising targeting domains according to SEQ ID NOs: 391 and 388 (RNA sequences are SEQ ID NOs: 538 and 558, respectively); a CMV promoter and gRNAs comprising targeting domains according to SEQ ID NOs: 391 and 392 (RNA sequences are SEQ ID NOs: 538 and 460, respectively); a CMV promoter and gRNAs comprising targeting domains according to SEQ ID NOs: 391 and 394 (RNA sequences are SEQ ID NOs: 538 and 568, respectively); an EFS promoter and gRNAs comprising targeting domains according to SEQ ID NOs: 389 and 388 (RNA sequences are SEQ ID NOs: 530 and 558, respectively); an EFS promoter and gRNAs comprising targeting domains according to SEQ ID NOs: 389 and 392 (RNA sequences are SEQ ID NOs: 530 and 460, respectively); an EFS promoter and gRNAs comprising targeting domains according to SEQ ID NOs: 389 and 394 (RNA sequences are SEQ ID NOs: 530 and 568, respectively); an EFS promoter and gRNAs comprising targeting domains according to SEQ ID NOs: 390 and 388 (RNA sequences are SEQ ID NOs: 468 and 558, respectively); an EFS promoter and gRNAs comprising targeting domains according to SEQ ID NOs: 390 and 392 (RNA sequences are SEQ ID NOs: 468 and 460, respectively); an EFS promoter and gRNAs comprising targeting domains according to SEQ ID NOs: 390 and 394 (RNA sequences are SEQ ID NOs: 468 and 568, respectively); an EFS promoter and gRNAs comprising targeting domains according to SEQ ID NOs: 391 and 388 (RNA sequences are SEQ ID NOs: 538 and 558, respectively); an EFS promoter and gRNAs comprising targeting domains according to SEQ ID NOs: 391 and 392 (RNA sequences are SEQ ID NOs: 538 and 460, respectively); an EFS promoter and gRNAs comprising targeting domains according to SEQ ID NOs: 391 and 394 (RNA sequences are SEQ ID NOs: 538 and 568, respectively); an hGRK1 promoter and gRNAs comprising targeting domains according to SEQ ID NOs: 389 and 388 (RNA sequences are SEQ ID NOs: 530 and 558, respectively); an hGRK1 promoter and gRNAs comprising targeting domains according to SEQ ID NOs: 389 and 392 (RNA sequences are SEQ ID NOs: 530 and 460, respectively); an hGRK1 promoter and gRNAs comprising targeting domains according to SEQ ID NOs: 389 and 394 (RNA sequences are SEQ ID NOs: 530 and 568, respectively); an hGRK1 promoter and gRNAs comprising targeting domains according to SEQ ID NOs: 390 and 388 (RNA sequences are SEQ ID NOs: 468 and 558, respectively); an hGRK1 promoter and gRNAs comprising targeting domains according to SEQ ID NOs: 390 and 392 (RNA sequences are SEQ ID NOs: 468 and 460, respectively); an hGRK1 promoter and gRNAs comprising targeting domains according to SEQ ID NOs: 390 and 394 (RNA sequences are SEQ ID NOs: 468 and 568, respectively); an hGRK1 promoter and gRNAs comprising targeting domains according to SEQ ID NOs: 391 and 388 (RNA sequences are SEQ ID NOs: 538 and 558, respectively); an hGRK1 promoter and gRNAs comprising targeting domains according to SEQ ID NOs: 391 and 392 (RNA sequences are SEQ ID NOs: 538 and 460, respectively); or an hGRK1 promoter and gRNAs comprising targeting domains according to SEQ ID NOs: 391 and 394 (RNA sequences are SEQ ID NOs: 538 and 568, respectively).

In various embodiments, the nucleic acid or AAV vector encodes the following: left and right AAV2 ITR sequences, a first U6 promoter to drive expression of a first guide RNA having a sequence selected from SEQ ID NOs: 2785 and 2787 and/or comprising a targeting domain sequence according to one of SEQ ID NOs: 389-391, a second U6 promoter to drive expression of a second guide RNA comprising a sequence selected from SEQ ID NOs: 2785 and 2787 and/or comprising a targeting domain sequence according to one of SEQ ID NOs: 388, 392, and 394, and a CMV promoter to drive expression of an *S. aureus* Cas9 encoded by SEQ ID NO: 39; or left and right AAV2 ITR sequences, a first U6 promoter to drive expression of a first guide RNA having a sequence selected from SEQ ID NOs: 2785 or 2787 and/or comprising a targeting domain sequence according to one of SEQ ID NOs: 389-391, a second U6 promoter to drive expression of a second guide RNA comprising a sequence selected from SEQ ID NOs: 2785 and 2787 and/or comprising a targeting domain sequence according to one of SEQ ID NOs: 388, 392, and 394, and an hGRK promoter to drive expression of an *S. aureus* Cas9 encoded by SEQ ID NO: 39; or left and right AAV2 ITR sequences, a first U6 promoter to drive expression of a first guide RNA having a sequence selected from SEQ ID NOs: 2785 and 2787 and/or comprising a targeting domain sequence according to one of SEQ ID NOs: 389-391, a second U6 promoter to drive expression of a second guide RNA comprising a sequence selected from SEQ ID NOs: 2785 or 2787 and/or comprising a targeting domain sequence according to one of SEQ ID NOs: 388, 392, and 394, and an EFS promoter to drive expression of an *S. aureus* Cas9 encoded by SEQ ID NO: 39.

In some embodiments, the nucleic acid or AAV vector shares at least 80%, 85%, 90%, 95%, 96%, 97%, 98%, 99% or greater sequence identity with one of the nucleic acids or AAV vectors recited above.

It should be noted that these sequences described above are exemplary, and can be modified in ways that do not disrupt the operating principles of elements they encode. Such modifications, some of which are discussed below, are within the scope of this disclosure. Without limiting the foregoing, skilled artisans will appreciate that the DNA, RNA or protein sequences of the elements of this disclosure may be varied in ways that do not interrupt their function, and that a variety of similar sequences that are substantially similar (e.g., greater than 90%, 95%, 96%, 97%, 98% or 99% sequence similarity, or in the case of short sequences such as gRNA targeting domains, sequences that differ by no more than 1, 2 or 3 nucleotides) can be utilized in the various systems, methods and AAV vectors described herein. Such modified sequences are within the scope of this disclosure.

The AAV genomes described above can be packaged into AAV capsids (for example, AAV5 capsids), which capsids can be included in compositions (such as pharmaceutical compositions) and/or administered to subjects. An exemplary pharmaceutical composition comprising an AAV capsid according to this disclosure can include a pharmaceutically acceptable carrier such as balanced saline solution (BSS) and one or more surfactants (e.g., Tween20) and/or a thermosensitive or reverse-thermosensitive polymer (e.g., pluronic). Other pharmaceutical formulation elements known in the art may also be suitable for use in the compositions described here.

Compositions comprising AAV vectors according to this disclosure can be administered to subjects by any suitable means, including without limitation injection, for example, subretinal injection. The concentration of AAV vector within the composition is selected to ensure, among other things, that a sufficient AAV dose is administered to the retina of the subject, taking account of dead volume within the injection apparatus and the relatively limited volume that can be safely administered to the retina. Suitable doses may include, for example, $1 \times 10^{11}$ viral genomes (vg)/mL, $2 \times 10^{11}$ viral genomes (vg)/mL, $3 \times 10^{11}$ viral genomes (vg)/mL, $4 \times 10^{11}$ viral genomes (vg)/mL, $5 \times 10^{11}$ viral genomes (vg)/mL, $6 \times 10^{11}$ viral genomes (vg)/mL, $7 \times 10^{11}$ viral genomes (vg)/mL, $8 \times 10^{11}$ viral genomes (vg)/mL, $9 \times 10^{11}$ viral genomes (vg)/mL, $1 \times 10^{12}$ vg/mL, $2 \times 10^{12}$ viral genomes (vg)/mL, $3 \times 10^{12}$ viral genomes (vg)/mL, $4 \times 10^{12}$ viral genomes (vg)/mL, $5 \times 10^{12}$ viral genomes (vg)/mL, $6 \times 10^{12}$ viral genomes (vg)/mL, $7 \times 10^{12}$ viral genomes (vg)/mL, $8 \times 10^{12}$ viral genomes (vg)/mL, $9 \times 10^{12}$ viral genomes (vg)/mL, $1 \times 10^{13}$ vg/mL, $2 \times 10^{13}$ viral genomes (vg)/mL, $3 \times 10^{13}$ viral genomes (vg)/mL, $4 \times 10^{13}$ viral genomes (vg)/mL, $5 \times 10^{13}$ viral genomes (vg)/mL, $6 \times 10^{13}$ viral genomes (vg)/mL, $7 \times 10^{13}$ viral genomes (vg)/mL, $8 \times 10^{13}$ viral genomes (vg)/mL, or $9 \times 10^{13}$ viral genomes (vg)/mL. Any suitable volume of the composition may be delivered to the subretinal space. In some instances, the volume is selected to form a bleb in the subretinal space, for example 1 microliter, 10 microliters, 50 microliters, 100 microliters, 150 microliters, 200 microliters, 250 microliters, 300 microliters, etc.

Any region of the retina may be targeted, though the fovea (which extends approximately 1 degree out from the center of the eye) may be preferred in certain instances due to its role in central visual acuity and the relatively high concentration of cone photoreceptors there relative to peripheral regions of the retina. Alternatively or additionally, injections may be targeted to parafoveal regions (extending between approximately 2 and 10 degrees off center), which are characterized by the presence of all three types of retinal photoreceptor cells. In addition, injections into the parafoveal region may be made at comparatively acute angles using needle paths that cross the midline of the retina. For instance, injection paths may extend from the nasal aspect of the sclera near the limbus through the vitreal chamber and into the parafoveal retina on the temporal side, from the temporal aspect of the sclera to the parafoveal retina on the nasal side, from a portion of the sclera located superior to the cornea to an inferior parafoveal position, and/or from an inferior portion of the sclera to a superior parafoveal position. The use of relatively small angles of injection relative to the retinal surface may advantageously reduce or limit the potential for spillover of vector from the bleb into the vitreous body and, consequently, reduce the loss of the vector during delivery. In other cases, the macula (inclusive of the fovea) can be targeted, and in other cases, additional retinal regions can be targeted, or can receive spillover doses.

For pre-clinical development purposes, systems, compositions, nucleotides and vectors according to this disclosure can be evaluated ex vivo using a retinal explant system, or in vivo using an animal model such as a mouse, rabbit, pig, nonhuman primate, etc. Retinal explants are optionally maintained on a support matrix, and AAV vectors can be delivered by injection into the space between the photoreceptor layer and the support matrix, to mimic subretinal injection. Tissue for retinal explanation can be obtained from human or animal subjects, for example mouse.

Explants are particularly useful for studying the expression of gRNAs and/or Cas9 following viral transduction, and for studying genome editing over comparatively short intervals. These models also permit higher throughput than may be possible in animal models, and can be predictive of expression and genome editing in animal models and subjects. Small (mouse, rat) and large animal models (such as rabbit, pig, nonhuman primate) can be used for pharmacological and/or toxicological studies and for testing the systems, nucleotides, vectors and compositions of this disclosure under conditions and at volumes that approximate those that will be used in clinic. Because model systems are selected to recapitulate relevant aspects of human anatomy and/or physiology, the data obtained in these systems will generally (though not necessarily) be predictive of the behavior of AAV vectors and compositions according to this disclosure in human and animal subjects.

Figure 25B:
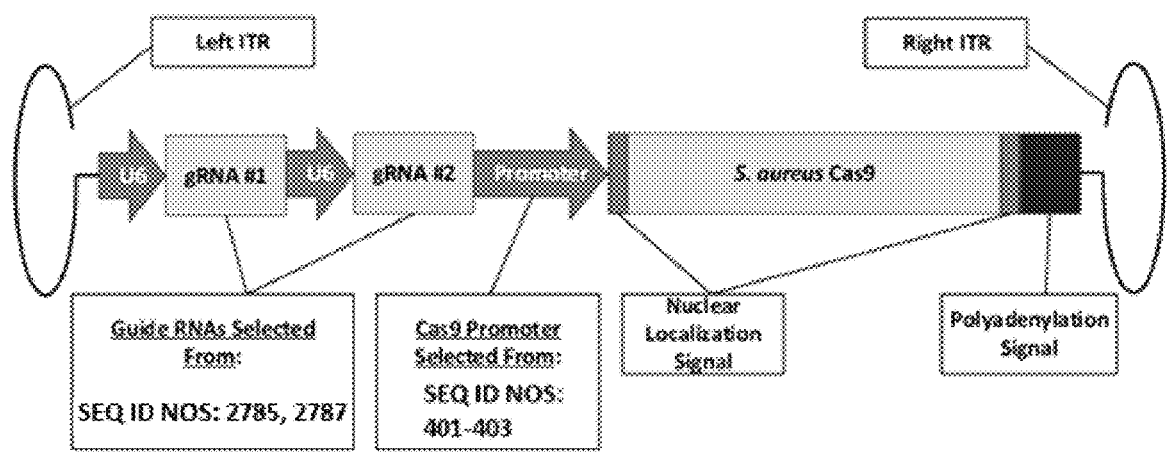
Figure 25C:
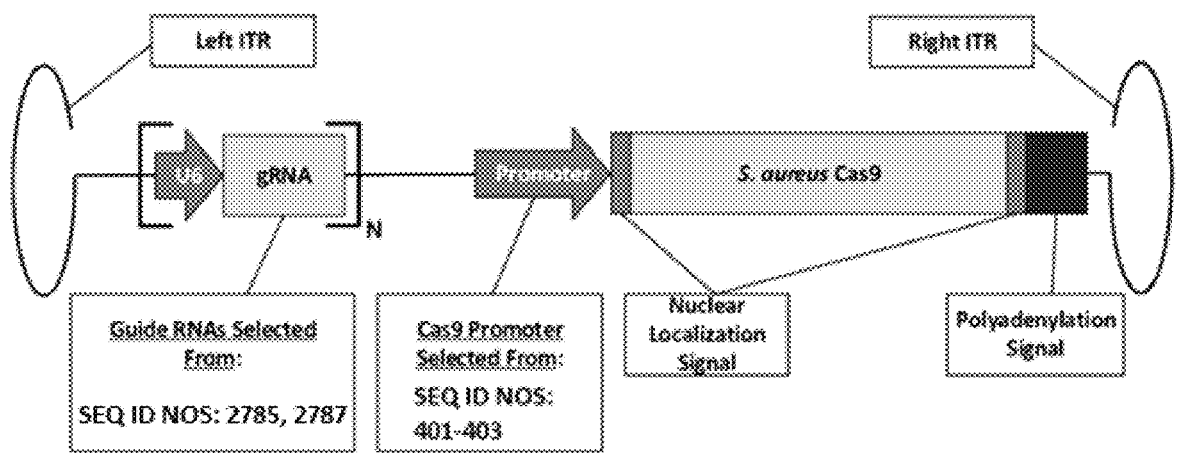
Figure 26:
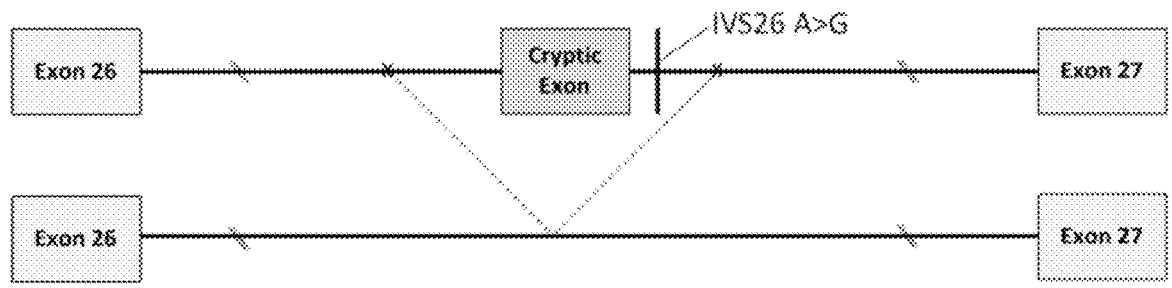
FIG. 26 illustrates the genome editing strategy implemented in certain embodiments of this disclosure.

While the foregoing exemplary embodiments have focused on guide RNAs, nucleic acids and AAV vectors targeted to the CEP290 gene, it will be appreciated by those of skill in the art that the nucleic acids and vectors of this disclosure may be used in the editing of other gene targets and the treatment of other diseases such as hereditary retinopathies that may be treated by editing of genes other than CEP290. FIGS. 25B and 25C illustrate two exemplary AAV vectors that may be used to transduce retinal cells, including without limitation retinal photoreceptor cells such as rod photoreceptors and/or cone photoreceptors, and/or other retinal cell types. The AAV genome of FIG. 25B comprises two guide RNAs according to SEQ ID NOs: 2785 or 2787, and a promoter sequence according to one of SEQ ID NOs: 401-403 driving expression of an S. aureus Cas9 comprising one or two nuclear localization signals and, optionally, a polyadenylation signal. The vector may additionally include ITRs such as AAV2 ITRs, or other sequences that may be selected for the specific application to which the vector will be employed. As is shown in FIG. 25C, other vectors within the scope of this disclosure may include only 1 guide RNA. Thus, in specific embodiments, an AAV genome of this disclosure may encode a CMV promoter for the Cas9 and one guide RNA having a sequence comprising, or sharing at least 90% sequence identity with, a sequence selected from SEQ ID NOs: 2785 and 2787; a CMV promoter for the Cas9 and two guide RNAs, each having a sequence comprising, or sharing at least 90% sequence identity with, a sequence selected from SEQ ID NOs: 2785 and 2787; an hGRK promoter for the Cas9 and one guide RNA having a sequence comprising, or sharing at least 90% sequence identity with, a sequence selected from SEQ ID NOs: 2785 and 2787; an hGRK promoter for the Cas9 and two guide RNAs, each having a sequence comprising, or sharing at least 90% sequence identity with, a sequence selected from SEQ ID NOs: 2785 and 2787; an EFS promoter for the Cas9 and one guide RNA having a sequence comprising, or sharing at least 90% sequence identity with, a sequence selected from SEQ ID NOs: 2785 and 2787; an EFS promoter for the Cas9 and two guide RNAs, each having a sequence comprising, or sharing at least 90% sequence identity with, a sequence selected from SEQ ID NOs: 2785 and 2787.

DNA-Based Delivery of a Cas9 Molecule and/or a gRNA Molecule

Nucleic acids encoding Cas9 molecules (e.g., eaCas9 molecules) and/or gRNA molecules, can be administered to subjects or delivered into cells by art-known methods or as described herein. For example, Cas9-encoding and/or gRNA-encoding DNA can be delivered, e.g., by vectors (e.g., viral or non-viral vectors), non-vector based methods (e.g., using naked DNA or DNA complexes), or a combination thereof.

DNA encoding Cas9 molecules (e.g., eaCas9 molecules) and/or gRNA molecules can be conjugated to molecules (e.g., N-acetylgalactosamine) promoting uptake by the target cells (e.g., the target cells described herein). Donor template molecules can be conjugated to molecules (e.g., N-acetylgalactosamine) promoting uptake by the target cells (e.g., the target cells described herein).

In some embodiments, the Cas9- and/or gRNA-encoding DNA is delivered by a vector (e.g., viral vector/virus or plasmid).

A vector can comprise a sequence that encodes a Cas9 molecule and/or a gRNA molecule. A vector can also comprise a sequence encoding a signal peptide (e.g., for nuclear localization, nucleolar localization, mitochondrial localization), fused, e.g., to a Cas9 molecule sequence. For example, a vector can comprise a nuclear localization sequence (e.g., from SV40) fused to the sequence encoding the Cas9 molecule.

One or more regulatory/control elements, e.g., a promoter, an enhancer, an intron, a polyadenylation signal, a Kozak consensus sequence, internal ribosome entry sites (IRES), a 2A sequence, and splice acceptor or donor can be included in the vectors. In some embodiments, the promoter is recognized by RNA polymerase II (e.g., a CMV promoter). In other embodiments, the promoter is recognized by RNA polymerase III (e.g., a U6 promoter). In some embodiments, the promoter is a regulated promoter (e.g., inducible promoter). In other embodiments, the promoter is a constitutive promoter. In some embodiments, the promoter is a tissue specific promoter. In some embodiments, the promoter is a viral promoter. In other embodiments, the promoter is a non-viral promoter.

In some embodiments, the vector or delivery vehicle is a viral vector (e.g., for generation of recombinant viruses). In some embodiments, the virus is a DNA virus (e.g., dsDNA or ssDNA virus). In other embodiments, the virus is an RNA virus (e.g., an ssRNA virus). Exemplary viral vectors/viruses include, e.g., retroviruses, lentiviruses, adenovirus, adeno-associated virus (AAV), vaccinia viruses, poxviruses, and herpes simplex viruses.

In some embodiments, the virus infects dividing cells. In other embodiments, the virus infects non-dividing cells. In some embodiments, the virus infects both dividing and non-dividing cells. In some embodiments, the virus can integrate into the host genome. In some embodiments, the virus is engineered to have reduced immunity, e.g., in human. In some embodiments, the virus is replication-competent. In other embodiments, the virus is replication-defective, e.g., having one or more coding regions for the genes necessary for additional rounds of virion replication and/or packaging replaced with other genes or deleted. In some embodiments, the virus causes transient expression of the Cas9 molecule and/or the gRNA molecule. In other embodiments, the virus causes long-lasting, e.g., at least 1 week, 2 weeks, 1 month, 2 months, 3 months, 6 months, 9 months, 1 year, 2 years, or permanent expression, of the Cas9 molecule and/or the gRNA molecule. The packaging capacity of the viruses may vary, e.g., from at least about 4 kb to at least about 30 kb, e.g., at least about 5 kb, 10 kb, 15 kb, 20 kb, 25 kb, 30 kb, 35 kb, 40 kb, 45 kb, or 50 kb.

In an embodiment, the viral vector recognizes a specific cell type or tissue. For example, the viral vector can be pseudotyped with a different/alternative viral envelope glycoprotein; engineered with a cell type-specific receptor (e.g., genetic modification(s) of one or more viral envelope glycoproteins to incorporate a targeting ligand such as a peptide ligand, a single chain antibody, or a growth factor); and/or engineered to have a molecular bridge with dual specificities with one end recognizing a viral glycoprotein and the other end recognizing a moiety of the target cell surface (e.g., a ligand-receptor, monoclonal antibody, avidin-biotin and chemical conjugation).

In some embodiments, the Cas9- and/or gRNA-encoding DNA is delivered by a recombinant retrovirus. In some embodiments, the retrovirus (e.g., Moloney murine leukemia virus) comprises a reverse transcriptase, e.g., that allows integration into the host genome. In some embodiments, the retrovirus is replication-competent. In other embodiments, the retrovirus is replication-defective, e.g., having one of more coding regions for the genes necessary for additional rounds of virion replication and packaging replaced with other genes, or deleted. In some embodiments, the Cas9- and/or gRNA-encoding DNA is delivered by a recombinant lentivirus. For example, the lentivirus is replication-defective, e.g., does not comprise one or more genes required for viral replication.

In some embodiments, the Cas9- and/or gRNA-encoding DNA is delivered by a recombinant adenovirus. In some embodiments, the adenovirus is engineered to have reduced immunity in human.

In some embodiments, the Cas9- and/or gRNA-encoding DNA is delivered by a recombinant AAV. In some embodiments, the AAV does not incorporate its genome into that of a host cell, e.g., a target cell as describe herein. In some embodiments, the AAV can incorporate at least part of its genome into that of a host cell, e.g., a target cell as described herein. In some embodiments, the AAV is a self-complementary adeno-associated virus (scAAV), e.g., a scAAV that packages both strands which anneal together to form double stranded DNA. AAV serotypes that may be used in the disclosed methods, include AAV1, AAV2, modified AAV2 (e.g., modifications at Y444F, Y500F, Y730F and/or S662V), AAV3, modified AAV3 (e.g., modifications at Y705F, Y731F and/or T492V), AAV4, AAV5, AAV6, modified AAV6 (e.g., modifications at S663V and/or T492V), AAV8, AAV 8.2, AAV9, AAV rh10, and pseudotyped AAV, such as AAV2/8, AAV2/5 and AAV2/6 can also be used in the disclosed methods. In an embodiment, an AAV capsid that can be used in the methods described herein is a capsid sequence from serotype AAV1, AAV2, AAV3, AAV4, AAV5, AAV6, AAV7, AAV8, AAV9, AAV.rh8, AAV.rh10, AAV.rh32/33, AAV.rh43, AAV.rh64R1, or AAV7m8. Exemplary AAV serotypes and ITR sequences are disclosed in Table 25.

In an embodiment, the Cas9- and/or gRNA-encoding DNA is delivered in a re-engineered AAV capsid, e.g., with 50% or greater, e.g., 60% or greater, 70% or greater, 80% or greater, 90% or greater, or 95% or greater, sequence homology with a capsid sequence from serotypes AAV1, AAV2, AAV3, AAV4, AAV5, AAV6, AAV7, AAV8, AAV9, AAV.rh8, AAV.rh10, AAV.rh32/33, AAV.rh43, or AAV.rh64R1.

In an embodiment, the Cas9- and/or gRNA-encoding DNA is delivered by a chimeric AAV capsid. Exemplary chimeric AAV capsids include, but are not limited to, AAV9i1, AAV2i8, AAV-DJ, AAV2G9, AAV2i8G9, or AAV8G9.

In an embodiment, the AAV is a self-complementary adeno-associated virus (scAAV), e.g., a scAAV that packages both strands which anneal together to form double stranded DNA.

In some embodiments, the Cas9- and/or gRNA-encoding DNA is delivered by a hybrid virus, e.g., a hybrid of one or more of the viruses described herein. In an embodiment, the hybrid virus is hybrid of an AAV (e.g., of any AAV serotype), with a Bocavirus, B19 virus, porcine AAV, goose AAV, feline AAV, canine AAV, or MVM.

A packaging cell is used to form a virus particle that is capable of infecting a target cell. Such a cell includes a 293 cell, which can package adenovirus, and a ψ2 cell or a PA317 cell, which can package retrovirus. A viral vector used in gene therapy is usually generated by a producer cell line that packages a nucleic acid vector into a viral particle. The vector typically contains the minimal viral sequences required for packaging and subsequent integration into a host or target cell (if applicable), with other viral sequences being replaced by an expression cassette encoding the protein to be expressed, e.g., Cas9. For example, an AAV vector used in gene therapy typically only possesses inverted terminal repeat (ITR) sequences from the AAV genome which are required for packaging and gene expression in the host or target cell. The missing viral functions can be supplied in trans by the packaging cell line and/or plasmid containing E2A, E4, and VA genes from adenovirus, and plasmid encoding Rep and Cap genes from AAV, as described in "Triple Transfection Protocol." Henceforth, the viral DNA is packaged in a cell line, which contains a helper plasmid encoding the other AAV genes, namely rep and cap, but lacking ITR sequences. In embodiment, the viral DNA is packaged in a producer cell line, which contains E1A and/or E1B genes from adenovirus. The cell line is also infected with adenovirus as a helper. The helper virus (e.g., adenovirus or HSV) or helper plasmid promotes replication of the AAV vector and expression of AAV genes from the plasmid with ITRs. The helper plasmid is not packaged in significant amounts due to a lack of ITR sequences. Contamination with adenovirus can be reduced by, e.g., heat treatment to which adenovirus is more sensitive than AAV.

In an embodiment, the viral vector has the ability of cell type and/or tissue type recognition. For example, the viral vector can be pseudotyped with a different/alternative viral envelope glycoprotein; engineered with a cell type-specific receptor (e.g., genetic modification of the viral envelope glycoproteins to incorporate targeting ligands such as a peptide ligand, a single chain antibody, a growth factor); and/or engineered to have a molecular bridge with dual specificities with one end recognizing a viral glycoprotein and the other end recognizing a moiety of the target cell surface (e.g., ligand-receptor, monoclonal antibody, avidin-biotin and chemical conjugation).

In an embodiment, the viral vector achieves cell type specific expression. For example, a tissue-specific promoter can be constructed to restrict expression of the transgene (Cas 9 and gRNA) in only the target cell. The specificity of the vector can also be mediated by microRNA-dependent control of transgene expression. In an embodiment, the viral vector has increased efficiency of fusion of the viral vector and a target cell membrane. For example, a fusion protein such as fusion-competent hemagglutin (HA) can be incorporated to increase viral uptake into cells. In an embodiment, the viral vector has the ability of nuclear localization. For example, a virus that requires the breakdown of the cell wall (during cell division) and therefore will not infect a non-diving cell can be altered to incorporate a nuclear localization peptide in the matrix protein of the virus thereby enabling the transduction of non-proliferating cells.

In some embodiments, the Cas9- and/or gRNA-encoding DNA is delivered by a non-vector based method (e.g., using naked DNA or DNA complexes). For example, the DNA can be delivered, e.g., by organically modified silica or silicate (Ormosil), electroporation, gene gun, sonoporation, magnetofection, lipid-mediated transfection, dendrimers, inorganic nanoparticles, calcium phosphates, or a combination thereof.

In some embodiments, the Cas9- and/or gRNA-encoding DNA is delivered by a combination of a vector and a non-vector based method. For example, a virosome comprises a liposome combined with an inactivated virus (e.g., HIV or influenza virus), which can result in more efficient gene transfer, e.g., in a respiratory epithelial cell than either a viral or a liposomal method alone.

In an embodiment, the delivery vehicle is a non-viral vector. In an embodiment, the non-viral vector is an inorganic nanoparticle. Exemplary inorganic nanoparticles include, e.g., magnetic nanoparticles (e.g., $Fe_3MnO_2$) and silica. The outer surface of the nanoparticle can be conjugated with a positively charged polymer (e.g., polyethylenimine, polylysine, polyserine) which allows for attachment (e.g., conjugation or entrapment) of payload. In an embodiment, the non-viral vector is an organic nanoparticle (e.g., entrapment of the payload inside the nanoparticle). Exemplary organic nanoparticles include, e.g., SNALP liposomes that contain cationic lipids together with neutral helper lipids which are coated with polyethylene glycol (PEG) and protamine and nucleic acid complex coated with lipid coating.

Exemplary lipids for gene transfer are shown below in Table 21.

TABLE 21

Lipids Used for Gene Transfer

| Lipid | Abbreviation | Feature |
|---|---|---|
| 1,2-Dioleoyl-sn-glycero-3-phosphatidylcholine | DOPC | Helper |
| 1,2-Dioleoyl-sn-glycero-3-phosphatidylethanolamine | DOPE | Helper |
| Cholesterol | | Helper |
| N-[1-(2,3-Dioleyloxy)prophyl]N,N,N-trimethylammonium chloride | DOTMA | Cationic |
| 1,2-Dioleoyloxy-3-trimethylammonium-propane | DOTAP | Cationic |
| Dioctadecylamidoglycylspermine | DOGS | Cationic |
| N-(3-Aminopropyl)-N,N-dimethyl-2,3-bis(dodecyloxy)-1-propanaminium bromide | GAP-DLRIE | Cationic |
| Cetyltrimethylammonium bromide | CTAB | Cationic |
| 6-Lauroxyhexyl ornithinate | LHON | Cationic |
| 1-(2,3-Dioleoyloxypropyl)-2,4,6-trimethylpyridinium | 2Oc | Cationic |
| 2,3-Dioleyloxy-N-[2(sperminecarboxamido-ethyl]-N,N-dimethyl-1-propanaminium trifluoroacetate | DOSPA | Cationic |
| 1,2-Dioleyl-3-trimethylammonium-propane | DOPA | Cationic |
| N-(2-Hydroxyethyl)-N,N-dimethyl-2,3-bis(tetradecyloxy)-1-propanaminium bromide | MDRIE | Cationic |
| Dimyristooxypropyl dimethyl hydroxyethyl ammonium bromide | DMRI | Cationic |
| 3β-[N-(N',N'-Dimethylaminoethane)-carbamoyl]cholesterol | DC-Chol | Cationic |
| Bis-guanidium-tren-cholesterol | BGTC | Cationic |
| 1,3-Diodeoxy-2-(6-carboxy-spermyl)-propylamide | DOSPER | Cationic |
| Dimethyloctadecylammonium bromide | DDAB | Cationic |
| Dioctadecylamidoglicylspermidin | DSL | Cationic |
| rac-[(2,3-Dioctadecyloxypropyl)(2-hydroxyethyl)]-dimethylammonium chloride | CLIP-1 | Cationic |
| rac-[2(2,3-Dihexadecyloxypropyl-oxymethyloxy)ethyl]trimethylammonium bromide | CLIP-6 | Cationic |
| Ethyldimyristoylphosphatidylcholine | EDMPC | Cationic |
| 1,2-Distearyloxy-N,N-dimethyl-3-aminopropane | DSDMA | Cationic |
| 1,2-Dimyristoyl-trimethylammonium propane | DMTAP | Cationic |
| O,O'-Dimyristyl-N-lysyl aspartate | DMKE | Cationic |
| 1,2-Distearoyl-sn-glycero-3-ethylphosphocholine | DSEPC | Cationic |
| N-Palmitoyl D-erythro-sphingosyl carbamoyl-spermine | CCS | Cationic |
| N-t-Butyl-N0-tetradecyl-3-tetradecylaminopropionamidine | diC14-amidine | Cationic |
| Octadecenolyoxy[ethyl-2-heptadecenyl-3 hydroxyethyl]imidazolinium chloride | DOTIM | Cationic |
| N1-Cholesteryloxycarbonyl-3,7-diazanonane-1,9-diamine | CDAN | Cationic |
| 2-(3-[Bis(3-amino-propyl)-amino]propylamino)-N-ditetradecylcarbamoylme-ethyl-acetamide | RPR209120 | Cationic |
| 1,2-dilinoleyloxy-3-dimethylaminopropane | DLinDMA | Cationic |
| 2,2-dilinoleyl-4-dimethylaminoethyl-[1,3]-dioxolane | DLin-KC2-DMA | Cationic |
| dilinoleyl-methyl-4-dimethylaminobutyrate | DLin-MC3-DMA | Cationic |

Exemplary polymers for gene transfer are shown below in Table 22.

TABLE 22

Polymers Used for Gene Transfer

| Polymer | Abbreviation |
|---|---|
| Poly(ethylene)glycol | PEG |
| Polyethylenimine | PEI |
| Dithiobis(succinimidylpropionate) | DSP |
| Dimethyl-3,3'-dithiobispropionimidate | DTBP |
| Poly(ethylene imine)biscarbamate | PEIC |
| Poly(L-lysine) | PLL |
| Histidine modified PLL | |
| Poly(N-vinylpyrrolidone) | PVP |
| Poly(propylenimine) | PPI |
| Poly(amidoamine) | PAMAM |
| Poly(amidoethylenimine) | SS-PAEI |
| Triethylenetetramine | TETA |
| Poly(β-aminoester) | |
| Poly(4-hydroxy-L-proline ester) | PHP |
| Poly(allylamine) | |
| Poly(α-[4-aminobutyl]-L-glycolic acid) | PAGA |
| Poly(D,L-lactic-co-glycolic acid) | PLGA |
| Poly(N-ethyl-4-vinylpyridinium bromide) | |
| Poly(phosphazene)s | PPZ |
| Poly(phosphoester)s | PPE |
| Poly(phosphoramidate)s | PPA |
| Poly(N-2-hydroxypropylmethacrylamide) | pHPMA |
| Poly (2-(dimethylamino)ethyl methacrylate) | pDMAEMA |
| Poly(2-aminoethyl propylene phosphate) | PPE-EA |
| Chitosan | |
| Galactosylated chitosan | |
| N-Dodacylated chitosan | |
| Histone | |
| Collagen | |
| Dextran-spermine | D-SPM |

In an embodiment, the vehicle has targeting modifications to increase target cell update of nanoparticles and liposomes, e.g., cell specific antigens, monoclonal antibodies, single chain antibodies, aptamers, polymers, sugars, and cell penetrating peptides. In an embodiment, the vehicle uses fusogenic and endosome-destabilizing peptides/polymers. In an embodiment, the vehicle undergoes acid-triggered conformational changes (e.g., to accelerate endosomal escape of the cargo). In an embodiment, a stimuli-cleavable polymer is used, e.g., for release in a cellular compartment. For example, disulfide-based cationic polymers that are cleaved in the reducing cellular environment can be used.

In an embodiment, the delivery vehicle is a biological non-viral delivery vehicle. In an embodiment, the vehicle is an attenuated bacterium (e.g., naturally or artificially engineered to be invasive but attenuated to prevent pathogenesis and expressing the transgene (e.g., *Listeria monocytogenes*, certain *Salmonella* strains, *Bifidobacterium longum*, and modified *Escherichia coli*), bacteria having nutritional and tissue-specific tropism to target specific tissues, bacteria having modified surface proteins to alter target tissue specificity). In an embodiment, the vehicle is a genetically modified bacteriophage (e.g., engineered phages having large packaging capacity, less immunogenic, containing mammalian plasmid maintenance sequences and having incorporated targeting ligands). In an embodiment, the vehicle is a mammalian virus-like particle. For example, modified viral particles can be generated (e.g., by purification of the "empty" particles followed by ex vivo assembly of the virus with the desired cargo). The vehicle can also be engineered to incorporate targeting ligands to alter target tissue specificity. In an embodiment, the vehicle is a biological liposome. For example, the biological liposome is a phospholipid-based particle derived from human cells (e.g., erythrocyte ghosts, which are red blood cells broken down into spherical structures derived from the subject (e.g., tissue targeting can be achieved by attachment of various tissue or cell-specific ligands), or secretory exosomes—subject (i.e., patient) derived membrane-bound nanovesicle (30-100 nm) of endocytic origin (e.g., can be produced from various cell types and can therefore be taken up by cells without the need of for targeting ligands).

In an embodiment, one or more nucleic acid molecules (e.g., DNA molecules) other than the components of a Cas system, e.g., the Cas9 molecule component and/or the gRNA molecule component described herein, are delivered. In an embodiment, the nucleic acid molecule is delivered at the same time as one or more of the components of the Cas system are delivered. In an embodiment, the nucleic acid molecule is delivered before or after (e.g., less than about 30 minutes, 1 hour, 2 hours, 3 hours, 6 hours, 9 hours, 12 hours, 1 day, 2 days, 3 days, 1 week, 2 weeks, or 4 weeks) one or more of the components of the Cas system are delivered. In an embodiment, the nucleic acid molecule is delivered by a different means than one or more of the components of the Cas system, e.g., the Cas9 molecule component and/or the gRNA molecule component, are delivered. The nucleic acid molecule can be delivered by any of the delivery methods described herein. For example, the nucleic acid molecule can be delivered by a viral vector, e.g., an integration-deficient lentivirus, and the Cas9 molecule component and/or the gRNA molecule component can be delivered by electroporation, e.g., such that the toxicity caused by nucleic acids (e.g., DNAs) can be reduced. In an embodiment, the nucleic acid molecule encodes a therapeutic protein, e.g., a protein described herein. In an embodiment, the nucleic acid molecule encodes an RNA molecule, e.g., an RNA molecule described herein.

Delivery of RNA Encoding a Cas9 Molecule

RNA encoding Cas9 molecules (e.g., eaCas9 molecules) and/or gRNA molecules, can be delivered into cells, e.g., target cells described herein, by art-known methods or as described herein. For example, Cas9-encoding and/or gRNA-encoding RNA can be delivered, e.g., by microinjection, electroporation, lipid-mediated transfection, peptide-mediated delivery, or a combination thereof. Cas9-encoding and/or gRNA-encoding RNA can be conjugated to molecules (e.g., GalNAc) promoting uptake by the target cells (e.g., target cells described herein).

Delivery Cas9 Protein

Cas9 molecules (e.g., eaCas9 molecules) can be delivered into cells by art-known methods or as described herein. For example, Cas9 protein molecules can be delivered, e.g., by microinjection, electroporation, lipid-mediated transfection, peptide-mediated delivery, or a combination thereof. Delivery can be accompanied by DNA encoding a gRNA or by a gRNA. Cas9-encoding and/or gRNA-encoding RNA can be conjugated to molecules (e.g., GalNAc) promoting uptake by the target cells (e.g., target cells described herein).

Route of Administration

Systemic modes of administration include oral and parenteral routes. Parenteral routes include, by way of example, intravenous, intraarterial, intramuscular, intradermal, subcutaneous, intranasal and intraperitoneal routes. Components administered systemically may be modified or formulated to target the components to the eye.

Local modes of administration include, by way of example, intraocular, intraorbital, subconjuctival, intravitreal, subretinal or transscleral routes. In an embodiment, significantly smaller amounts of the components (compared with systemic approaches) may exert an effect when administered locally (for example, intravitreally) compared to when administered systemically (for example, intravenously). Local modes of administration can reduce or eliminate the incidence of potentially toxic side effects that may occur when therapeutically effective amounts of a component are administered systemically.

In an embodiment, components described herein are delivered subretinally, e.g., by subretinal injection. Subretinal injections may be made directly into the macular, e.g., submacular injection.

In an embodiment, components described herein are delivered by intravitreal injection. Intravitreal injection has a relatively low risk of retinal detachment. In an embodiment, nanoparticle or viral, e.g., AAV vector, is delivered intravitreally.

Methods for administration of agents to the eye are known in the medical arts and can be used to administer components described herein. Exemplary methods include intraocular injection (e.g., retrobulbar, subretinal, submacular, intravitreal and intrachoridal), iontophoresis, eye drops, and intraocular implantation (e.g., intravitreal, sub-Tenons and sub-conjunctival).

Administration may be provided as a periodic bolus (for example, subretinally, intravenously or intravitreally) or as continuous infusion from an internal reservoir (for example, from an implant disposed at an intra- or extra-ocular location (see, U.S. Pat. Nos. 5,443,505 and 5,766,242)) or from an external reservoir (for example, from an intravenous bag). Components may be administered locally, for example, by continuous release from a sustained release drug delivery device immobilized to an inner wall of the eye or via targeted transscleral controlled release into the choroid (see, e.g., PCT/US00/00207; PCT/US02/14279; Ambati 2000a; Ambati 2000b. A variety of devices suitable for administering components locally to the inside of the eye are known in the art. See, for example, U.S. Pat. Nos. 6,251,090; 6,299,895; 6,416,777; and 6,413,540; and PCT Appl. No. PCT/US00/28187.

In addition, components may be formulated to permit release over a prolonged period of time. A release system can include a matrix of a biodegradable material or a material which releases the incorporated components by diffusion. The components can be homogeneously or heterogeneously distributed within the release system. A variety of release systems may be useful, however, the choice of the appropriate system will depend upon rate of release required by a particular application. Both non-degradable and degradable release systems can be used. Suitable release systems include polymers and polymeric matrices, non-polymeric matrices, or inorganic and organic excipients and diluents such as, but not limited to, calcium carbonate and sugar (for example, trehalose). Release systems may be natural or synthetic. However, synthetic release systems are preferred because generally they are more reliable, more reproducible and produce more defined release profiles. The release system material can be selected so that components having different molecular weights are released by diffusion through or degradation of the material.

Representative synthetic, biodegradable polymers include, for example: polyamides such as poly(amino acids) and poly(peptides); polyesters such as poly(lactic acid), poly(glycolic acid), poly(lactic-co-glycolic acid), and poly (caprolactone); poly(anhydrides); polyorthoesters; polycarbonates; and chemical derivatives thereof (substitutions, additions of chemical groups, for example, alkyl, alkylene, hydroxylations, oxidations, and other modifications routinely made by those skilled in the art), copolymers and mixtures thereof. Representative synthetic, non-degradable polymers include, for example: polyethers such as poly (ethylene oxide), poly(ethylene glycol), and poly(tetramethylene oxide); vinyl polymers-polyacrylates and polymethacrylates such as methyl, ethyl, other alkyl, hydroxyethyl methacrylate, acrylic and methacrylic acids, and others such as poly(vinyl alcohol), poly(vinyl pyrolidone), and poly (vinyl acetate); poly(urethanes); cellulose and its derivatives such as alkyl, hydroxyalkyl, ethers, esters, nitrocellulose, and various cellulose acetates; polysiloxanes; and any chemical derivatives thereof (substitutions, additions of chemical groups, for example, alkyl, alkylene, hydroxylations, oxidations, and other modifications routinely made by those skilled in the art), copolymers and mixtures thereof.

Poly(lactide-co-glycolide) microsphere can also be used for intraocular injection. Typically the microspheres are composed of a polymer of lactic acid and glycolic acid, which are structured to form hollow spheres. The spheres can be approximately 15-30 microns in diameter and can be loaded with components described herein.

Bi-Modal or Differential Delivery of Components

Separate delivery of the components of a Cas system, e.g., the Cas9 molecule component and the gRNA molecule component, and more particularly, delivery of the components by differing modes, can enhance performance, e.g., by improving tissue specificity and safety.

In an embodiment, the Cas9 molecule and the gRNA molecule are delivered by different modes, or as sometimes referred to herein as differential modes. Different or differential modes, as used herein, refer modes of delivery that confer different pharmacodynamic or pharmacokinetic properties on the subject component molecule, e.g., a Cas9 molecule, gRNA molecule, template nucleic acid, or payload. For example, the modes of delivery can result in different tissue distribution, different half-life, or different temporal distribution, e.g., in a selected compartment, tissue, or organ.

Some modes of delivery, e.g., delivery by a nucleic acid vector that persists in a cell, or in progeny of a cell, e.g., by autonomous replication or insertion into cellular nucleic acid, result in more persistent expression of and presence of a component. Examples include viral, e.g., adeno associated virus or lentivirus, delivery.

By way of example, the components, e.g., a Cas9 molecule and a gRNA molecule, can be delivered by modes that differ in terms of resulting half-life or persistent of the delivered component the body, or in a particular compartment, tissue or organ. In an embodiment, a gRNA molecule can be delivered by such modes. The Cas9 molecule component can be delivered by a mode which results in less persistence or less exposure to the body or a particular compartment or tissue or organ.

More generally, in an embodiment, a first mode of delivery is used to deliver a first component and a second mode of delivery is used to deliver a second component. The first mode of delivery confers a first pharmacodynamic or pharmacokinetic property. The first pharmacodynamic property can be, e.g., distribution, persistence, or exposure, of the component, or of a nucleic acid that encodes the component, in the body, a compartment, tissue or organ. The second mode of delivery confers a second pharmacodynamic or pharmacokinetic property. The second pharmacodynamic property can be, e.g., distribution, persistence, or exposure, of the component, or of a nucleic acid that encodes the component, in the body, a compartment, tissue or organ.

In an embodiment, the first pharmacodynamic or pharmacokinetic property, e.g., distribution, persistence or exposure, is more limited than the second pharmacodynamic or pharmacokinetic property.

In an embodiment, the first mode of delivery is selected to optimize, e.g., minimize, a pharmacodynamic or pharmacokinetic property, e.g., distribution, persistence or exposure.

In an embodiment, the second mode of delivery is selected to optimize, e.g., maximize, a pharmacodynamic or pharmacokinetic property, e.g., distribution, persistence or exposure.

In an embodiment, the first mode of delivery comprises the use of a relatively persistent element, e.g., a nucleic acid, e.g., a plasmid or viral vector, e.g., an AAV or lentivirus. As such vectors are relatively persistent product transcribed from them would be relatively persistent.

In an embodiment, the second mode of delivery comprises a relatively transient element, e.g., an RNA or protein.

In an embodiment, the first component comprises gRNA, and the delivery mode is relatively persistent, e.g., the gRNA is transcribed from a plasmid or viral vector, e.g., an AAV or lentivirus. Transcription of these genes would be of little physiological consequence because the genes do not encode for a protein product, and the gRNAs are incapable of acting in isolation. The second component, a Cas9 molecule, is delivered in a transient manner, for example as mRNA or as protein, ensuring that the full Cas9 molecule/gRNA molecule complex is only present and active for a short period of time.

Furthermore, the components can be delivered in different molecular form or with different delivery vectors that complement one another to enhance safety and tissue specificity.

Use of differential delivery modes can enhance performance, safety and efficacy. E.g., the likelihood of an eventual off-target modification can be reduced. Delivery of immunogenic components, e.g., Cas9 molecules, by less persistent modes can reduce immunogenicity, as peptides from the bacterially-derived Cas enzyme are displayed on the surface of the cell by MHC molecules. A two-part delivery system can alleviate these drawbacks.

Differential delivery modes can be used to deliver components to different, but overlapping target regions. The formation active complex is minimized outside the overlap of the target regions. Thus, in an embodiment, a first component, e.g., a gRNA molecule is delivered by a first delivery mode that results in a first spatial, e.g., tissue, distribution. A second component, e.g., a Cas9 molecule is delivered by a second delivery mode that results in a second spatial, e.g., tissue, distribution. In an embodiment the first mode comprises a first element selected from a liposome, nanoparticle, e.g., polymeric nanoparticle, and a nucleic acid, e.g., viral vector. The second mode comprises a second element selected from the group. In an embodiment, the first mode of delivery comprises a first targeting element, e.g., a cell specific receptor or an antibody, and the second mode of delivery does not include that element. In embodiment, the second mode of delivery comprises a second targeting element, e.g., a second cell specific receptor or second antibody.

When the Cas9 molecule is delivered in a virus delivery vector, a liposome, or polymeric nanoparticle, there is the potential for delivery to and therapeutic activity in multiple tissues, when it may be desirable to only target a single tissue. A two-part delivery system can resolve this challenge and enhance tissue specificity. If the gRNA molecule and the Cas9 molecule are packaged in separated delivery vehicles with distinct but overlapping tissue tropism, the fully functional complex is only be formed in the tissue that is targeted by both vectors.

Ex Vivo Delivery

In some embodiments, components described in Table 18 are introduced into cells which are then introduced into the subject. Methods of introducing the components can include, e.g., any of the delivery methods described in Table 19.

VIII. Modified Nucleosides, Nucleotides, and Nucleic Acids

Modified nucleosides and modified nucleotides can be present in nucleic acids, e.g., particularly gRNA, but also other forms of RNA, e.g., mRNA, RNAi, or siRNA. As described herein, "nucleoside" is defined as a compound containing a five-carbon sugar molecule (a pentose or ribose) or derivative thereof, and an organic base, purine or pyrimidine, or a derivative thereof. As described herein, "nucleotide" is defined as a nucleoside further comprising a phosphate group.

Modified nucleosides and nucleotides can include one or more of:

(i) alteration, e.g., replacement, of one or both of the non-linking phosphate oxygens and/or of one or more of the linking phosphate oxygens in the phosphodiester backbone linkage;

(ii) alteration, e.g., replacement, of a constituent of the ribose sugar, e.g., of the 2' hydroxyl on the ribose sugar;

(iii) wholesale replacement of the phosphate moiety with "dephospho" linkers; (iv) modification or replacement of a naturally occurring nucleobase;

(v) replacement or modification of the ribose-phosphate backbone;

(vi) modification of the 3' end or 5' end of the oligonucleotide, e.g., removal, modification or replacement of a terminal phosphate group or conjugation of a moiety; and (vii) modification of the sugar.

The modifications listed above can be combined to provide modified nucleosides and nucleotides that can have two, three, four, or more modifications. For example, a modified nucleoside or nucleotide can have a modified sugar and a modified nucleobase. In an embodiment, every base of a gRNA is modified, e.g., all bases have a modified phosphate group, e.g., all are phosphorothioate groups. In an embodiment, all, or substantially all, of the phosphate groups of a unimolecular or modular gRNA molecule are replaced with phosphorothioate groups.

In an embodiment, modified nucleotides, e.g., nucleotides having modifications as described herein, can be incorporated into a nucleic acid, e.g., a "modified nucleic acid." In some embodiments, the modified nucleic acids comprise one, two, three or more modified nucleotides. In some embodiments, at least 5% (e.g., at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100%) of the positions in a modified nucleic acid are a modified nucleotides.

Unmodified nucleic acids can be prone to degradation by, e.g., cellular nucleases. For example, nucleases can hydrolyze nucleic acid phosphodiester bonds. Accordingly, in one aspect the modified nucleic acids described herein can contain one or more modified nucleosides or nucleotides, e.g., to introduce stability toward nucleases.

In some embodiments, the modified nucleosides, modified nucleotides, and modified nucleic acids described herein can exhibit a reduced innate immune response when introduced into a population of cells, both in vivo and ex vivo. The term "innate immune response" includes a cellular response to exogenous nucleic acids, including single stranded nucleic acids, generally of viral or bacterial origin, which involves the induction of cytokine expression and release, particularly the interferons, and cell death. In some embodiments, the modified nucleosides, modified nucleotides, and modified nucleic acids described herein can disrupt binding of a major groove interacting partner with the nucleic acid. In some embodiments, the modified nucleosides, modified nucleotides, and modified nucleic acids described herein can exhibit a reduced innate immune response when introduced into a population of cells, both in vivo and ex vivo, and also disrupt binding of a major groove interacting partner with the nucleic acid.

Definitions of Chemical Groups

As used herein, "alkyl" is meant to refer to a saturated hydrocarbon group which is straight-chained or branched. Example alkyl groups include methyl (Me), ethyl (Et), propyl (e.g., n-propyl and isopropyl), butyl (e.g., n-butyl, isobutyl, t-butyl), pentyl (e.g., n-pentyl, isopentyl, neopentyl), and the like. An alkyl group can contain from 1 to about 20, from 2 to about 20, from 1 to about 12, from 1 to about 8, from 1 to about 6, from 1 to about 4, or from 1 to about 3 carbon atoms.

As used herein, "aryl" refers to monocyclic or polycyclic (e.g., having 2, 3 or 4 fused rings) aromatic hydrocarbons such as, for example, phenyl, naphthyl, anthracenyl, phenanthrenyl, indanyl, indenyl, and the like. In some embodiments, aryl groups have from 6 to about 20 carbon atoms.

As used herein, "alkenyl" refers to an aliphatic group containing at least one double bond.

As used herein, "alkynyl" refers to a straight or branched hydrocarbon chain containing 2-12 carbon atoms and characterized in having one or more triple bonds. Examples of alkynyl groups include, but are not limited to, ethynyl, propargyl, and 3-hexynyl.

As used herein, "arylalkyl" or "aralkyl" refers to an alkyl moiety in which an alkyl hydrogen atom is replaced by an aryl group. Aralkyl includes groups in which more than one hydrogen atom has been replaced by an aryl group. Examples of "arylalkyl" or "aralkyl" include benzyl, 2-phenylethyl, 3-phenylpropyl, 9-fluorenyl, benzhydryl, and trityl groups.

As used herein, "cycloalkyl" refers to a cyclic, bicyclic, tricyclic, or polycyclic non-aromatic hydrocarbon groups having 3 to 12 carbons. Examples of cycloalkyl moieties include, but are not limited to, cyclopropyl, cyclopentyl, and cyclohexyl.

As used herein, "heterocyclyl" refers to a monovalent radical of a heterocyclic ring system. Representative heterocyclyls include, without limitation, tetrahydrofuranyl, tetrahydrothienyl, pyrrolidinyl, pyrrolidonyl, piperidinyl, pyrrolinyl, piperazinyl, dioxanyl, dioxolanyl, diazepinyl, oxazepinyl, thiazepinyl, and morpholinyl.

As used herein, "heteroaryl" refers to a monovalent radical of a heteroaromatic ring system. Examples of heteroaryl moieties include, but are not limited to, imidazolyl, oxazolyl, thiazolyl, triazolyl, pyrrolyl, furanyl, indolyl, thiophenyl pyrazolyl, pyridinyl, pyrazinyl, pyridazinyl, pyrimidinyl, indolizinyl, purinyl, naphthyridinyl, quinolyl, and pteridinyl.

Phosphate Backbone Modifications

Phosphate Group

In some embodiments, the phosphate group of a modified nucleotide can be modified by replacing one or more of the oxygens with a different substituent. Further, the modified nucleotide, e.g., modified nucleotide present in a modified nucleic acid, can include the wholesale replacement of an unmodified phosphate moiety with a modified phosphate as described herein. In some embodiments, the modification of the phosphate backbone can include alterations that result in either an uncharged linker or a charged linker with unsymmetrical charge distribution.

Examples of modified phosphate groups include, phosphorothioate, phosphoroselenates, borano phosphates, borano phosphate esters, hydrogen phosphonates, phosphoroamidates, alkyl or aryl phosphonates and phosphotriesters. In some embodiments, one of the non-bridging phosphate oxygen atoms in the phosphate backbone moiety can be replaced by any of the following groups: sulfur (S), selenium (Se), $BR_3$ (wherein R can be, e.g., hydrogen, alkyl, or aryl), C (e.g., an alkyl group, an aryl group, and the like), H, $NR_2$ (wherein R can be, e.g., hydrogen, alkyl, or aryl), or OR (wherein R can be, e.g., alkyl or aryl). The phosphorous atom in an unmodified phosphate group is achiral. However, replacement of one of the non-bridging oxygens with one of the above atoms or groups of atoms can render the phosphorous atom chiral; that is to say that a phosphorous atom in a phosphate group modified in this way is a stereogenic center. The stereogenic phosphorous atom can possess either the "R" configuration (herein Rp) or the "S" configuration (herein Sp).

Phosphorodithioates have both non-bridging oxygens replaced by sulfur. The phosphorus center in the phosphorodithioates is achiral which precludes the formation of oligoribonucleotide diastereomers. In some embodiments, modifications to one or both non-bridging oxygens can also include the replacement of the non-bridging oxygens with a group independently selected from S, Se, B, C, H, N, and OR (R can be, e.g., alkyl or aryl).

The phosphate linker can also be modified by replacement of a bridging oxygen, (i.e., the oxygen that links the phosphate to the nucleoside), with nitrogen (bridged phosphoroamidates), sulfur (bridged phosphorothioates) and carbon (bridged methylenephosphonates). The replacement can occur at either linking oxygen or at both of the linking oxygens.

Replacement of the Phosphate Group

The phosphate group can be replaced by non-phosphorus containing connectors. In some embodiments, the charge phosphate group can be replaced by a neutral moiety.

Examples of moieties which can replace the phosphate group can include, without limitation, e.g., methyl phosphonate, hydroxylamino, siloxane, carbonate, carboxymethyl, carbamate, amide, thioether, ethylene oxide linker, sulfonate, sulfonamide, thioformacetal, formacetal, oxime, methyleneimino, methylenemethylimino, methylenehydrazo, methylenedimethylhydrazo and methyleneoxymethylimino.

Replacement of the Ribophosphate Backbone

Scaffolds that can mimic nucleic acids can also be constructed wherein the phosphate linker and ribose sugar are replaced by nuclease resistant nucleoside or nucleotide surrogates. In some embodiments, the nucleobases can be tethered by a surrogate backbone. Examples can include, without limitation, the morpholino, cyclobutyl, pyrrolidine and peptide nucleic acid (PNA) nucleoside surrogates.

Sugar Modifications

The modified nucleosides and modified nucleotides can include one or more modifications to the sugar group. For example, the 2' hydroxyl group (OH) can be modified or replaced with a number of different "oxy" or "deoxy" substituents. In some embodiments, modifications to the 2' hydroxyl group can enhance the stability of the nucleic acid since the hydroxyl can no longer be deprotonated to form a 2'-alkoxide ion. The 2'-alkoxide can catalyze degradation by intramolecular nucleophilic attack on the linker phosphorus atom.

Examples of "oxy"-2' hydroxyl group modifications can include alkoxy or aryloxy (OR, wherein "R" can be, e.g., alkyl, cycloalkyl, aryl, aralkyl, heteroaryl or a sugar); polyethyleneglycols (PEG), $O(CH_2CH_2O)_nCH_2CH_2OR$ wherein R can be, e.g., H or optionally substituted alkyl, and n can be an integer from 0 to 20 (e.g., from 0 to 4, from 0 to 8, from 0 to 10, from 0 to 16, from 1 to 4, from 1 to 8, from 1 to 10, from 1 to 16, from 1 to 20, from 2 to 4, from 2 to 8, from 2 to 10, from 2 to 16, from 2 to 20, from 4 to 8, from 4 to 10, from 4 to 16, and from 4 to 20). In some embodiments, the "oxy"-2' hydroxyl group modification can include "locked" nucleic acids (LNA) in which the 2' hydroxyl can be connected, e.g., by a $C_{1-6}$ alkylene or $C_{1-6}$ heteroalkylene bridge, to the 4' carbon of the same ribose sugar, where exemplary bridges can include methylene, propylene, ether, or amino bridges; O-amino (wherein amino can be, e.g., $NH_2$; alkylamino, dialkylamino, heterocyclyl, arylamino, diarylamino, heteroarylamino, or diheteroarylamino, ethylenediamine, or polyamino) and aminoalkoxy, $O(CH_2)_n$-amino, (wherein amino can be, e.g., $NH_2$; alkylamino, dialkylamino, heterocyclyl, arylamino, diarylamino, heteroarylamino, or diheteroarylamino, ethylenediamine, or polyamino). In some embodiments, the "oxy"-2' hydroxyl group modification can include the methoxyethyl group (MOE), $(OCH_2CH_2OCH_3$, e.g., a PEG derivative).

"Deoxy" modifications can include hydrogen (i.e. deoxyribose sugars, e.g., at the overhang portions of partially ds RNA); halo (e.g., bromo, chloro, fluoro, or iodo); amino (wherein amino can be, e.g., $NH_2$; alkylamino, dialkylamino, heterocyclyl, arylamino, diarylamino, heteroarylamino, diheteroarylamino, or amino acid); $NH(CH_2CH_2NH)_nCH_2CH_2$-amino (wherein amino can be, e.g., as described herein), —NHC(O)R (wherein R can be, e.g., alkyl, cycloalkyl, aryl, aralkyl, heteroaryl or sugar), cyano; mercapto; alkyl-thio-alkyl; thioalkoxy; and alkyl, cycloalkyl, aryl, alkenyl and alkynyl, which may be optionally substituted with e.g., an amino as described herein.

The sugar group can also contain one or more carbons that possess the opposite stereochemical configuration than that of the corresponding carbon in ribose. Thus, a modified nucleic acid can include nucleotides containing e.g., arabinose, as the sugar. The nucleotide "monomer" can have an alpha linkage at the 1' position on the sugar, e.g., alpha-nucleosides. The modified nucleic acids can also include "abasic" sugars, which lack a nucleobase at C-1'. These abasic sugars can also be further modified at one or more of the constituent sugar atoms. The modified nucleic acids can also include one or more sugars that are in the L form, e.g. L-nucleosides.

Generally, RNA includes the sugar group ribose, which is a 5-membered ring having an oxygen. Exemplary modified nucleosides and modified nucleotides can include, without limitation, replacement of the oxygen in ribose (e.g., with sulfur (S), selenium (Se), or alkylene, such as, e.g., methylene or ethylene); addition of a double bond (e.g., to replace ribose with cyclopentenyl or cyclohexenyl); ring contraction of ribose (e.g., to form a 4-membered ring of cyclobutane or oxetane); ring expansion of ribose (e.g., to form a 6- or 7-membered ring having an additional carbon or heteroatom, such as for example, anhydrohexitol, altritol, mannitol, cyclohexanyl, cyclohexenyl, and morpholino that also has a phosphoramidate backbone). In some embodiments, the modified nucleotides can include multicyclic forms (e.g., tricyclo; and "unlocked" forms, such as glycol nucleic acid (GNA) (e.g., R-GNA or S-GNA, where ribose is replaced by glycol units attached to phosphodiester bonds), threose nucleic acid (TNA, where ribose is replaced with α-L-threofuranosyl-(3'→2')).

Modifications on the Nucleobase

The modified nucleosides and modified nucleotides described herein, which can be incorporated into a modified nucleic acid, can include a modified nucleobase. Examples of nucleobases include, but are not limited to, adenine (A), guanine (G), cytosine (C), and uracil (U). These nucleobases can be modified or wholly replaced to provide modified nucleosides and modified nucleotides that can be incorporated into modified nucleic acids. The nucleobase of the nucleotide can be independently selected from a purine, a pyrimidine, a purine or pyrimidine analog. In some embodiments, the nucleobase can include, for example, naturally-occurring and synthetic derivatives of a base.

Uracil

In some embodiments, the modified nucleobase is a modified uracil. Exemplary nucleobases and nucleosides having a modified uracil include without limitation pseudouridine (ψ), pyridin-4-one ribonucleoside, 5-aza-uridine, 6-aza-uridine, 2-thio-5-aza-uridine, 2-thio-uridine (s2U), 4-thio-uridine (s4U), 4-thio-pseudouridine, 2-thio-pseudouridine, 5-hydroxy-uridine ($ho^5U$), 5-aminoallyl-uridine, 5-halo-uridine (e.g., 5-iodo-uridine or 5-bromo-uridine), 3-methyl-uridine ($m^3U$), 5-methoxy-uridine ($mo^5U$), uridine 5-oxyacetic acid ($cmo^5U$), uridine 5-oxyacetic acid methyl ester ($mcmo^5U$), 5-carboxymethyl-uridine ($cm^5U$), 1-carboxymethyl-pseudouridine, 5-carboxyhydroxymethyl-uridine ($chm^5U$), 5-carboxyhydroxymethyl-uridine methyl ester ($mchm^5U$), 5-methoxycarbonylmethyl-uridine ($mcm^5U$), 5-methoxycarbonylmethyl-2-thio-uridine ($mcm^5s2U$), 5-aminomethyl-2-thio-uridine ($nm^5s2U$), 5-methylaminomethyl-uridine ($mnm^5U$), 5-methylaminomethyl-2-thio-uridine ($mnm^5s2U$), 5-methylaminomethyl-2-seleno-uridine ($mnm^5se^2U$), 5-carbamoylmethyl-uridine ($ncm^5U$), 5-carboxymethylaminomethyl-uridine ($cmnm^5U$), 5-carboxymethylaminomethyl-2-thio-uridine ($cmnm^5s2U$), 5-propynyl-uridine, 1-propynyl-pseudouridine, 5-taurinomethyl-uridine ($τcm^5U$), 1-taurinomethyl-pseudouridine, 5-taurinomethyl-2-thio-uridine ($τm^5s2U$), 1-taurinomethyl-4-thio-pseudouridine, 5-methyl-uridine ($m^5U$, i.e., having the nucleobase deoxythymine), 1-methyl-pseudouridine ($m^1ψ$), 5-methyl-2-thio-uridine ($m^5s2U$), 1-methyl-4-thio-pseudouridine ($m^1s^4ψ$), 4-thio-1-methyl-pseudouridine, 3-methyl-pseudouridine ($m^3ψ$), 2-thio-1-methyl-pseudouridine, 1-methyl-1-deaza-pseudouridine, 2-thio-1-methyl-1-deaza-pseudouridine, dihydrouridine (D), dihydropseudouridine, 5,6-dihydrouridine, 5-methyl-dihydrouridine ($m^5D$), 2-thio-dihydrouridine, 2-thio-dihydropseudouridine, 2-methoxy-uridine, 2-methoxy-4-thio-uridine, 4-methoxy-pseudouridine, 4-methoxy-2-thio-pseudouridine, N1-methyl-pseudouridine, 3-(3-amino-3-carboxypropyl)uridine ($acp^3U$), 1-methyl-3-(3-amino-3-carboxypropyl)pseudouridine ($acp^3ψ$), 5-(isopentenylaminomethyl)uridine (nm⁵U), 5-(isopentenylaminomethyl)-2-thio-uridine (inm⁵s2U), α-thio-uridine, 2'-O-methyl-uridine (Um), 5,2'-O-dimethyl-uridine (m⁵Um), 2'-O-methyl-pseudouridine (ψm), 2-thio-2'-O-methyl-uridine (s2Um), 5-methoxycarbonylmethyl-2'-O-methyl-uridine (mcm⁵Um), 5-carbamoylmethyl-2'-O-methyl-uridine (ncm ⁵Um), 5-carboxymethylaminomethyl-2'-O-methyl-uridine (cmnm ⁵Um), 3,2'-O-dimethyl-uridine (m³Um), 5-(isopentenylaminomethyl)-2'-O-methyl-uridine (inm⁵Um), 1-thio-uridine, deoxythymidine, 2'-F-ara-uridine, T-F-uridine, 2'-OH-ara-uridine, 5-(2-carbomethoxyvinyl) uridine, 5-[3-(1-E-propenylamino)uridine, pyrazolo[3,4-d]pyrimidines, xanthine, and hypoxanthine.

Cytosine

In some embodiments, the modified nucleobase is a modified cytosine. Exemplary nucleobases and nucleosides having a modified cytosine include without limitation 5-aza-cytidine, 6-aza-cytidine, pseudoisocytidine, 3-methyl-cytidine (m³C), N4-acetyl-cytidine (act), 5-formyl-cytidine (f⁵C), N4-methyl-cytidine (m⁴C), 5-methyl-cytidine (m⁵C), 5-halo-cytidine (e.g., 5-iodo-cytidine), 5-hydroxymethyl-cytidine (hm⁵C), 1-methyl-pseudoisocytidine, pyrrolo-cytidine, pyrrolo-pseudoisocytidine, 2-thio-cytidine (s2C), 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, 4-methoxy-1-methyl-pseudoisocytidine, lysidine (k²C), α-thio-cytidine, 2'-O-methyl-cytidine (Cm), 5,2'-O-dimethyl-cytidine (m⁵Cm), N4-acetyl-2'-O-methyl-cytidine (ac⁴Cm), N4,2'-O-dimethyl-cytidine (m⁴Cm), 5-formyl-2'-O-methyl-cytidine (f ⁵Cm), N4,N4,2'-O-trimethyl-cytidine (m⁴₂Cm), 1-thio-cytidine, 2'-F-ara-cytidine, 2'-F-cytidine, and 2'-OH-ara-cytidine.

Adenine

In some embodiments, the modified nucleobase is a modified adenine. Exemplary nucleobases and nucleosides having a modified adenine include without limitation 2-amino-purine, 2,6-diaminopurine, 2-amino-6-halo-purine (e.g., 2-amino-6-chloro-purine), 6-halo-purine (e.g., 6-chloro-purine), 2-amino-6-methyl-purine, 8-azido-adenosine, 7-deaza-adenine, 7-deaza-8-aza-adenine, 7-deaza-2-amino-purine, 7-deaza-8-aza-2-amino-purine, 7-deaza-2,6-diaminopurine, 7-deaza-8-aza-2,6-diaminopurine, 1-methyl-adenosine (m¹A), 2-methyl-adenine (m²A), N6-methyl-adenosine (m⁶A), 2-methylthio-N6-methyl-adenosine (ms2 m⁶A), N6-isopentenyl-adenosine (i⁶A), 2-methylthio-N6-isopentenyl-adenosine (ms²i⁶A), N6-(cis-hydroxyisopentenyl)adenosine (i⁶A), 2-methylthio-N6-(cis-hydroxyisopentenyl)adenosine (ms2io⁶A), N6-glycinylcarbamoyl-adenosine (g⁶A), N6-threonylcarbamoyl-adenosine (t⁶A), N6-methyl-N6-threonylcarbamoyl-adenosine (m⁶t⁶A), 2-methylthio-N6-threonylcarbamoyl-adenosine (ms²g⁶A), N6,N6-dimethyl-adenosine (m⁶2A), N6-hydroxynorvalylcarbamoyl-adenosine (hn⁶A), 2-methylthio-N6-hydroxynorvalylcarbamoyl-adenosine (ms2hn⁶A), N6-acetyl-adenosine (ac⁶A), 7-methyl-adenine, 2-methylthio-adenine, 2-methoxy-adenine, α-thio-adenosine, 2'-O-methyl-adenosine (Am), N⁶,2'-O-dimethyl-adenosine (m⁶Am), N⁶-Methyl-2'-deoxyadenosine, N6,N6,2'-O-trimethyl-adenosine (m⁶₂Am), 1,2'-O-dimethyl-adenosine (m¹Am), 2'-O-ribosyladenosine (phosphate) (Ar(p)), 2-amino-N6-methyl-purine, 1-thio-adenosine, 8-azido-adenosine, 2'-F-ara-adenosine, 2'-F-adenosine, 2'-OH-ara-adenosine, and N6-(19-amino-pentaoxanonadecyl)-adenosine.

Guanine

In some embodiments, the modified nucleobase is a modified guanine. Exemplary nucleobases and nucleosides having a modified guanine include without limitation inosine (I), 1-methyl-inosine (m¹I), wyosine (imG), methylwyosine (mimG), 4-demethyl-wyosine (imG-14), isowyosine (imG2), wybutosine (yW), peroxywybutosine (o₂yW), hydroxywybutosine (OHyW), undermodified hydroxywybutosine (OHyW*), 7-deaza-guanosine, queuosine (Q), epoxyqueuosine (oQ), galactosyl-queuosine (galQ), mannosyl-queuosine (manQ), 7-cyano-7-deaza-guanosine (preQ₀), 7-aminomethyl-7-deaza-guanosine (preQ₁), archaeosine (G⁺), 7-deaza-8-aza-guanosine, 6-thio-guanosine, 6-thio-7-deaza-guanosine, 6-thio-7-deaza-8-aza-guanosine, 7-methyl-guanosine (m⁷G), 6-thio-7-methyl-guanosine, 7-methyl-inosine, 6-methoxy-guanosine, 1-methyl-guanosine (m'G), N2-methyl-guanosine (m²G), N2,N2-dimethyl-guanosine (m²₂G), N2,7-dimethyl-guanosine (m²,7G), N2, N2,7-dimethyl-guanosine (m²,2,7G), 8-oxo-guanosine, 7-methyl-8-oxo-guanosine, 1-meth thio-guanosine, N2-methyl-6-thio-guanosine, N2,N2-dimethyl-6-thio-guanosine, α-thio-guanosine, 2'-O-methyl-guanosine (Gm), N2-methyl-2'-O-methyl-guanosine (m²Gm), N2,N2-dimethyl-2'-O-methyl-guanosine (m²₂Gm), 1-methyl-2'-O-methyl-guanosine (m'Gm), N2,7-dimethyl-2'-O-methyl-guanosine (m²,7Gm), 2'-O-methyl-inosine (Im), 1,2'-O-dimethyl-inosine (m'Im), O⁶-phenyl-2'-deoxyinosine, 2'-O-ribosylguanosine (phosphate) (Gr(p)), 1-thio-guanosine, O⁶-methyl-guanosine, O⁶-Methyl-2'-deoxyguanosine, 2'-F-ara-guanosine, and 2'-F-guanosine.

Modified gRNAs

In some embodiments, the modified nucleic acids can be modified gRNAs. In some embodiments, gRNAs can be modified at the 3' end. In this embodiment, the gRNAs can be modified at the 3' terminal U ribose. For example, the two terminal hydroxyl groups of the U ribose can be oxidized to aldehyde groups and a concomitant opening of the ribose ring to afford a modified nucleoside as shown below:

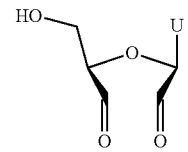

wherein "U" can be an unmodified or modified uridine.

In another embodiment, the 3' terminal U can be modified with a 2'3' cyclic phosphate as shown below:

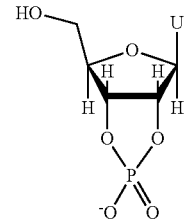

wherein "U" can be an unmodified or modified uridine.

In some embodiments, the gRNA molecules may contain 3' nucleotides which can be stabilized against degradation, e.g., by incorporating one or more of the modified nucleotides described herein. In this embodiment, e.g., uridines can be replaced with modified uridines, e.g., 5-(2-amino)propyl uridine, and 5-bromo uridine, or with any of the modified uridines described herein; adenosines and guanosines can be replaced with modified adenosines and guanosines, e.g., with modifications at the 8-position, e.g., 8-bromo guanosine, or with any of the modified adenosines or guanosines described herein. In some embodiments, deaza nucleotides, e.g., 7-deaza-adenosine, can be incorporated into the gRNA. In some embodiments, O- and N-alkylated nucleotides, e.g., N6-methyl adenosine, can be incorporated into the gRNA. In some embodiments, sugar-modified ribonucleotides can be incorporated, e.g., wherein the 2' OH— group is replaced by a group selected from H, —OR, —R (wherein R can be, e.g., alkyl, cycloalkyl, aryl, aralkyl, heteroaryl or sugar), halo, —SH, —SR (wherein R can be, e.g., alkyl, cycloalkyl, aryl, aralkyl, heteroaryl or sugar), amino (wherein amino can be, e.g., NH$_2$; alkylamino, dialkylamino, heterocyclyl, arylamino, diarylamino, heteroarylamino, diheteroarylamino, or amino acid); or cyano (—CN). In some embodiments, the phosphate backbone can be modified as described herein, e.g., with a phosphothioate group. In some embodiments, the nucleotides in the overhang region of the gRNA can each independently be a modified or unmodified nucleotide including, but not limited to 2'-sugar modified, such as, 2-F 2'-O-methyl, thymidine (T), 2'-O-methoxyethyl-5-methyluridine (Teo), 2'-O-methoxyethyladenosine (Aeo), 2'-O-methoxyethyl-5-methylcytidine (m5Ceo), and any combinations thereof.

In an embodiment, one or more or all of the nucleotides in single stranded RNA molecule, e.g., a gRNA molecule, are deoxynucleotides.

miRNA Binding Sites microRNAs (or miRNAs) are naturally occurring cellular 19-25 nucleotide long noncoding RNAs. They bind to nucleic acid molecules having an appropriate miRNA binding site, e.g., in the 3' UTR of an mRNA, and down-regulate gene expression. While not wishing to be bound by theory, in an embodiment, it is believed that the down regulation is either by reducing nucleic acid molecule stability or by inhibiting translation. An RNA species disclosed herein, e.g., an mRNA encoding Cas9 can comprise an miRNA binding site, e.g., in its 3'UTR. The miRNA binding site can be selected to promote down regulation of expression is a selected cell type. By way of example, the incorporation of a binding site for miR-122, a microRNA abundant in liver, can inhibit the expression of the gene of interest in the liver.

Governing gRNA Molecules and the Use Thereof to Limit the Activity of a Cas9 System Methods and compositions that use, or include, a nucleic acid, e.g., DNA, that encodes a Cas9 molecule or a gRNA molecule, can, in addition, use or include a "governing gRNA molecule." The governing gRNA can limit the activity of the other CRISPR/Cas components introduced into a cell or subject. In an embodiment, a gRNA molecule comprises a targeting domain that is complementary to a target domain on a nucleic acid that comprises a sequence that encodes a component of the CRISPR/Cas system that is introduced into a cell or subject. In an embodiment, a governing gRNA molecule comprises a targeting domain that is complementary with a target sequence on: (a) a nucleic acid that encodes a Cas9 molecule; (b) a nucleic acid that encodes a gRNA which comprises a targeting domain that targets the CEP290 gene (a target gene gRNA); or on more than one nucleic acid that encodes a CRISPR/Cas component, e.g., both (a) and (b). The governing gRNA molecule can complex with the Cas9 molecule to inactivate a component of the system. In an embodiment, a Cas9 molecule/governing gRNA molecule complex inactivates a nucleic acid that comprises the sequence encoding the Cas9 molecule. In an embodiment, a Cas9 molecule/governing gRNA molecule complex inactivates the nucleic acid that comprises the sequence encoding a target gene gRNA molecule. In an embodiment, a Cas9 molecule/governing gRNA molecule complex places temporal, level of expression, or other limits, on activity of the Cas9 molecule/target gene gRNA molecule complex. In an embodiment, a Cas9 molecule/governing gRNA molecule complex reduces off-target or other unwanted activity. In an embodiment, a governing gRNA molecule targets the coding sequence, or a control region, e.g., a promoter, for the CRISPR/Cas system component to be negatively regulated. For example, a governing gRNA can target the coding sequence for a Cas9 molecule, or a control region, e.g., a promoter, that regulates the expression of the Cas9 molecule coding sequence, or a sequence disposed between the two. In an embodiment, a governing gRNA molecule targets the coding sequence, or a control region, e.g., a promoter, for a target gene gRNA. In an embodiment, a governing gRNA, e.g., a Cas9-targeting or target gene gRNA-targeting, governing gRNA molecule, or a nucleic acid that encodes it, is introduced separately, e.g., later, than is the Cas9 molecule or a nucleic acid that encodes it. For example, a first vector, e.g., a viral vector, e.g., an AAV vector, can introduce nucleic acid encoding a Cas9 molecule and one or more target gene gRNA molecules, and a second vector, e.g., a viral vector, e.g., an AAV vector, can introduce nucleic acid encoding a governing gRNA molecule, e.g., a Cas9-targeting or target gene gRNA targeting, gRNA molecule. In an embodiment, the second vector can be introduced after the first. In other embodiments, a governing gRNA molecule, e.g., a Cas9-targeting or target gene gRNA targeting, governing gRNA molecule, or a nucleic acid that encodes it, can be introduced together, e.g., at the same time or in the same vector, with the Cas9 molecule or a nucleic acid that encodes it, but, e.g., under transcriptional control elements, e.g., a promoter or an enhancer, that are activated at a later time, e.g., such that after a period of time the transcription of Cas9 is reduced. In an embodiment, the transcriptional control element is activated intrinsically. In an embodiment, the transcriptional element is activated via the introduction of an external trigger.

Typically a nucleic acid sequence encoding a governing gRNA molecule, e.g., a Cas9-targeting gRNA molecule, is under the control of a different control region, e.g., promoter, than is the component it negatively modulates, e.g., a nucleic acid encoding a Cas9 molecule. In an embodiment, "different control region" refers to simply not being under the control of one control region, e.g., promoter, that is functionally coupled to both controlled sequences. In an embodiment, different refers to "different control region" in kind or type of control region. For example, the sequence encoding a governing gRNA molecule, e.g., a Cas9-targeting gRNA molecule, is under the control of a control region, e.g., a promoter, that has a lower level of expression, or is expressed later than the sequence which encodes is the component it negatively modulates, e.g., a nucleic acid encoding a Cas9 molecule.

By way of example, a sequence that encodes a governing gRNA molecule, e.g., a Cas9-targeting governing gRNA molecule, can be under the control of a control region (e.g., a promoter) described herein, e.g., human U6 small nuclear promoter, or human H1 promoter. In an embodiment, a sequence that encodes the component it negatively regulates, e.g., a nucleic acid encoding a Cas9 molecule, can be under the control of a control region (e.g., a promoter) described herein, e.g., CMV, EF-1α, MSCV, PGK, CAG control promoters.

EXAMPLES

The following Examples are merely illustrative and are not intended to limit the scope or content of the invention in any way.

Example 1: Cloning and Initial Screening of gRNAs

The suitability of candidate gRNAs can be evaluated as described in this example. Although described for a chimeric gRNA, the approach can also be used to evaluate modular gRNAs.

Cloning gRNAs into Plasmid Vector

For each gRNA, a pair of overlapping oligonucleotides is designed and obtained. Oligonucleotides are annealed and ligated into a digested vector backbone containing an upstream U6 promoter and the remaining sequence of a long chimeric gRNA. Plasmid is sequence-verified and prepped to generate sufficient amounts of transfection-quality DNA. Alternate promoters may be used to drive in vivo transcription (e.g., H1 promoter) or for in vitro transcription (e.g., T7 promoter).

Cloning gRNAs in Linear dsDNA Molecule (STITCHR)

For each gRNA, a single oligonucleotide is designed and obtained. The U6 promoter and the gRNA scaffold (e.g. including everything except the targeting domain, e.g., including sequences derived from the crRNA and tracrRNA, e.g., including a first complementarity domain; a linking domain; a second complementarity domain; a proximal domain; and a tail domain) are separately PCR amplified and purified as dsDNA molecules. The gRNA-specific oligonucleotide is used in a PCR reaction to stitch together the U6 and the gRNA scaffold, linked by the targeting domain specified in the oligonucleotide. Resulting dsDNA molecule (STITCHR product) is purified for transfection. Alternate promoters may be used to drive in vivo transcription (e.g., H1 promoter) or for in vitro transcription (e.g., T7 promoter). Any gRNA scaffold may be used to create gRNAs compatible with Cas9s from any bacterial species.

Initial gRNA Screen

Each gRNA to be tested is transfected, along with a plasmid expressing Cas9 and a small amount of a GFP-expressing plasmid into human cells. In preliminary experiments, these cells can be immortalized human cell lines such as 293T, K562 or U2OS. Alternatively, primary human cells may be used. In this case, cells may be relevant to the eventual therapeutic cell target (for example, photoreceptor cells). The use of primary cells similar to the potential therapeutic target cell population may provide important information on gene targeting rates in the context of endogenous chromatin and gene expression.

Transfection may be performed using lipid transfection (such as Lipofectamine or Fugene) or by electroporation. Following transfection, GFP expression can be determined either by fluorescence microscopy or by flow cytometry to confirm consistent and high levels of transfection. These preliminary transfections can comprise different gRNAs and different targeting approaches (17-mers, 20-mers, nuclease, dual-nickase, etc.) to determine which gRNAs/combinations of gRNAs give the greatest activity.

Efficiency of cleavage with each gRNA may be assessed by measuring NHEJ-induced indel formation at the target locus by a T7E1-type assay or by sequencing. Alternatively, other mismatch-sensitive enzymes, such as Cell/Surveyor nuclease, may also be used.

For the T7E1 assay, PCR amplicons are approximately 500-700 bp with the intended cut site placed asymmetrically in the amplicon. Following amplification, purification and size-verification of PCR products, DNA is denatured and re-hybridized by heating to 95° C. and then slowly cooling. Hybridized PCR products are then digested with T7 Endonuclease I (or other mismatch-sensitive enzyme) which recognizes and cleaves non-perfectly matched DNA. If indels are present in the original template DNA, when the amplicons are denatured and re-annealed, this results in the hybridization of DNA strands harboring different indels and therefore lead to double-stranded DNA that is not perfectly matched. Digestion products may be visualized by gel electrophoresis or by capillary electrophoresis. The fraction of DNA that is cleaved (density of cleavage products divided by the density of cleaved and uncleaved) may be used to estimate a percent NHEJ using the following equation: % NHEJ=$(1-(1-\text{fraction cleaved})^{1/2})$. The T7E1 assay is sensitive down to about 2-5% NHEJ.

Sequencing may be used instead of, or in addition to, the T7E1 assay. For Sanger sequencing, purified PCR amplicons are cloned into a plasmid backbone, transformed, miniprepped and sequenced with a single primer. For large sequencing numbers, Sanger sequencing may be used for determining the exact nature of indels after determining the NHEJ rate by T7E1.

Sequencing may also be performed using next generation sequencing techniques. When using next generation sequencing, amplicons may be 300-500 bp with the intended cut site placed asymmetrically. Following PCR, next generation sequencing adapters and barcodes (for example Illumina multiplex adapters and indexes) may be added to the ends of the amplicon, e.g., for use in high throughput sequencing (for example on an Illumina MiSeq). This method allows for detection of very low NHEJ rates.

Example 2: Assessment of Gene Targeting by NHEJ

The gRNAs that induce the greatest levels of NHEJ in initial tests can be selected for further evaluation of gene targeting efficiency. For example, cells may be derived from disease subjects, relevant cell lines, and/or animal models and, therefore, harbor the relevant mutation.

Following transfection (usually 2-3 days post-transfection) genomic DNA may be isolated from a bulk population of transfected cells and PCR may be used to amplify the target region. Following PCR, gene targeting efficiency to generate the desired mutations (either knockout of a target gene or removal of a target sequence motif) may be determined by sequencing. For Sanger sequencing, PCR amplicons may be 500-700 bp long. For next generation sequencing, PCR amplicons may be 300-500 bp long. If the goal is to knockout gene function, sequencing may be used to assess what percent of alleles have undergone NHEJ-induced indels that result in a frameshift or large deletion or insertion that would be expected to destroy gene function. If the goal is to remove a specific sequence motif, sequencing may be used to assess what percent of alleles have undergone NHEJ-induced deletions that span this sequence.

Example 3: Assessment of Activity of Individual gRNAs Targeting CEP290

Figure 11A:
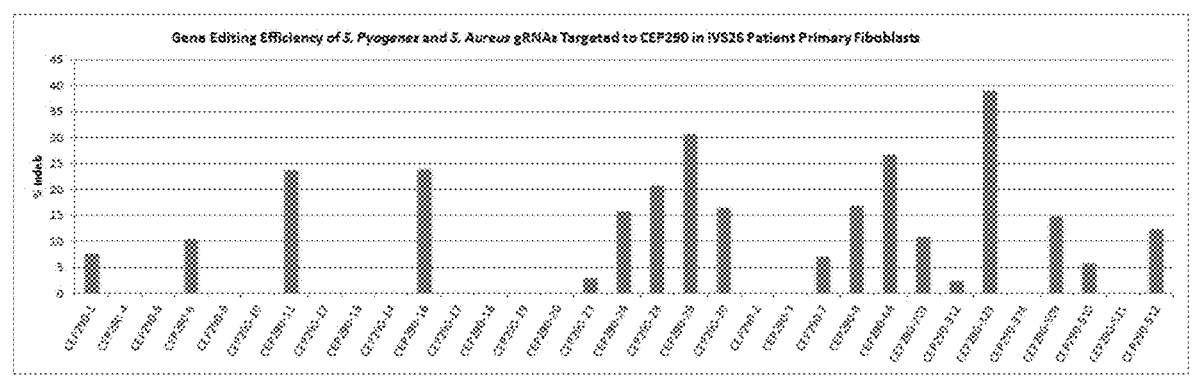
FIGS. 11A-11B show the rates of indels induced by various gRNAs at the CEP290 locus.
Figure 11B:
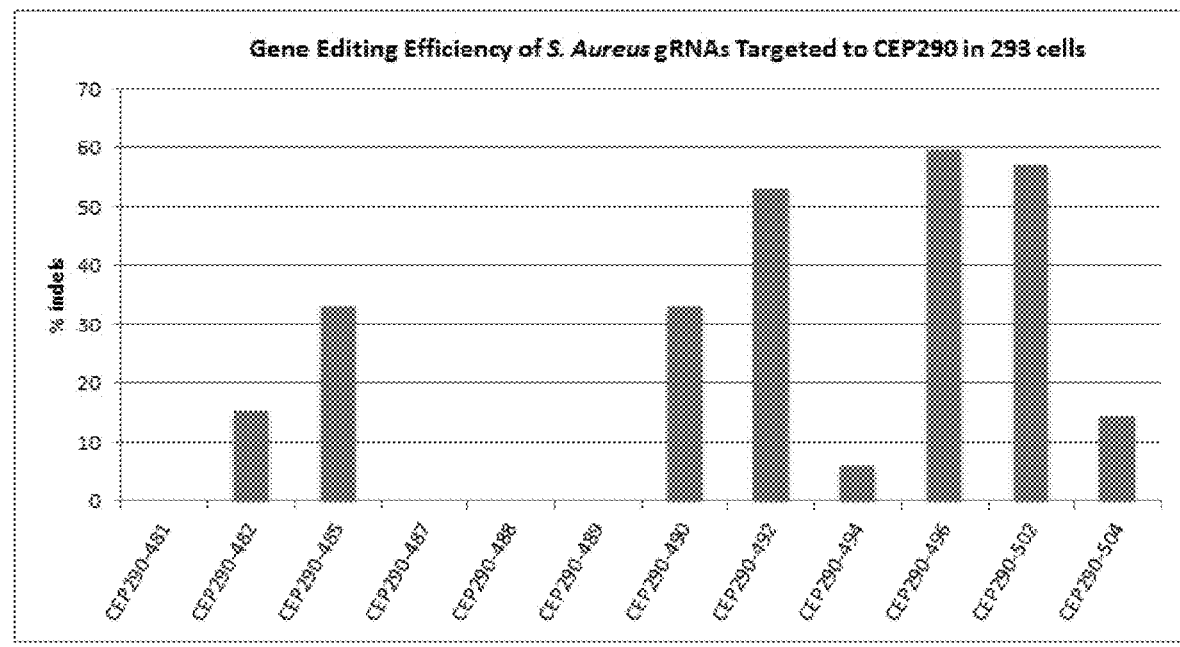

Guide RNA were identified using a custom guide RNA design software based on the public tool cas-offinder (Bae 2014). Each gRNA to be tested was generated as a STITCHR product and co-transfected with a plasmid expressing either S. aureus Cas9 (pAF003) or S. pyogenes Cas9 (pJDS246) into either HEK293 cells or primary fibroblasts derived from and LCA10 patient harboring homozygous IVS26 c.2991+1655A to G mutations (hereafter referred to as IVS26 fibroblasts). The pAF003 plasmid encodes the S. aureus Cas9, with N-terminal and C-terminal nuclear localization signals (NLS) and a C-terminal triple flag tag, driven by a CMV promoter. The pJDS246 plasmid encodes the S. pyogenes Cas9, with a C-terminal nuclear localization signal (NLS) and a C-terminal triple flag tag, driven by a CMV promoter. gRNA and Cas9-encoding DNA was introduced into cells by either Mirus TransIT-293 transfection reagent (for 293 cells) or by Amaxa nucleofection (for IVS26 fibroblasts). Nucleofection was optimized for transfection of IVS26 fibroblasts using solution P2 and various pulse codes and assaying for highest levels of gene editing and cell viability. Transfection efficiency in both cell types was assessed by transfecting with GFP and assaying expression by fluorescent microscopy. Three to seven days post-transfection, genomic DNA was isolated from bulk populations of transfected cells and the region of the CEP290 locus surrounding the target site was PCR amplified. PCR amplicons were then cloned into a plasmid backbone using the Zero-Blunt TOPO cloning kit (Life Technologies) and transformed into chemically competent Top10 cells. Bacterial colonies were then cultured and plasmid DNA was isolated and sequenced. Sequencing of PCR products allowed for the detection and quantification of targeted insertion and deletion (indel) events at the target site. FIGS. 11A and 11B show the rates of indels induced by various gRNAs at the CEP290 locus. FIG. 11A shows gene editing (% indels) as assessed by sequencing for S. pyogenes and S. aureus gRNAs when co-expressed with Cas9 in patient-derived IVS26 primary fibroblasts. FIG. 11B shows gene editing (% indels) as assessed by sequencing for S. aureus gRNAs when co-expressed with Cas9 in HEK293 cells.

Example 4: Detection of gRNA Pair-Induced Deletions by PCR

To assess the ability of a pair of gRNAs to induce a genomic deletion (in which the sequence between the two cut sites is removed), PCR was performed across the predicted deletion. Pairs of gRNAs (encoded as STITCHR products) were co-transfected with pAF003 into IVS26 fibroblasts. Genomic DNA was isolated from transfected cells and PCR was performed to amplify a segment of the CEP290 locus spanning the two predicted cut sites. PCR was run on a QIAxcel capillary electrophoresis machine. The predicted amplicon on a wildtype allele is 1816 bps. Assuming that cleavage occurs within the gRNA target region, amplicon sizes for alleles having undergone the deletion event were calculated and the presence of this smaller band indicates that the desired genomic deletion event has occurred (Table 23).

TABLE 23

| | Left gRNA | Right gRNA | Deletion Size | Amplicon with deletion | Deletion amplicon detected? |
|---|---|---|---|---|---|
| 1 | CEP290-367 | CEP290-16 | 590 | 1226 | no |
| 2 | CEP290-367 | CEP290-203 | 688 | 1128 | no |

TABLE 23-continued

| | Left gRNA | Right gRNA | Deletion Size | Amplicon with deletion | Deletion amplicon detected? |
|---|---|---|---|---|---|
| 3 | CEP290-367 | CEP290-132 | 815 | 1001 | no |
| 4 | CEP290-367 | CEP290-139 | 1265 | 551 | no |
| 5 | CEP290-312 | CEP290-11 | 790 | 1026 | yes |
| 6 | CEP290-312 | CEP290-252 | 973 | 843 | no |
| 7 | CEP290-312 | CEP290-64 | 976 | 840 | yes |
| 8 | CEP290-312 | CEP290-230 | 1409 | 407 | yes |
| 9 | CEP290-12 | CEP290-11 | 19 | 1797 | no |
| 10 | CEP290-12 | CEP290-252 | 202 | 1614 | no |
| 11 | CEP290-12 | CEP290-64 | 205 | 1611 | no |
| 12 | CEP290-12 | CEP290-230 | 638 | 1178 | no |
| 13 | CEP290-17 | CEP290-16 | 19 | 1797 | no |
| 14 | CEP290-17 | CEP290-203 | 117 | 1699 | no |
| 15 | CEP290-17 | CEP290-132 | 244 | 1572 | no |
| 16 | CEP290-17 | CEP290-139 | 693 | 1123 | no |
| 17 | CEP290-374 | CEP290-16 | 799 | 1017 | no |
| 18 | CEP290-374 | CEP290-203 | 897 | 919 | no |
| 19 | CEP290-374 | CEP290-132 | 1024 | 792 | no |
| 20 | CEP290-374 | CEP290-139 | 1473 | 343 | no |
| 21 | CEP290-368 | CEP290-16 | 854 | 962 | no |
| 22 | CEP290-368 | CEP290-203 | 952 | 864 | no |
| 23 | CEP290-368 | CEP290-132 | 1079 | 737 | no |
| 24 | CEP290-368 | CEP290-139 | 1528 | 288 | no |
| 25 | CEP290-323 | CEP290-11 | 990 | 826 | yes |
| 26 | CEP290-323 | CEP290-252 | 1173 | 643 | no |
| 27 | CEP290-323 | CEP290-64 | 1176 | 640 | yes |
| 28 | CEP290-323 | CEP290-230 | 1609 | 207 | yes |
| 29 | | Cas9 only | | wt amplicon = 1816 | no |
| 30 | | GFP only | | wt amplicon = 1816 | no |
| 31 | no DNA PCR neg ctrl | | | | |

Example 5: Gene Expression Analysis of CEP290

Figure 12A:
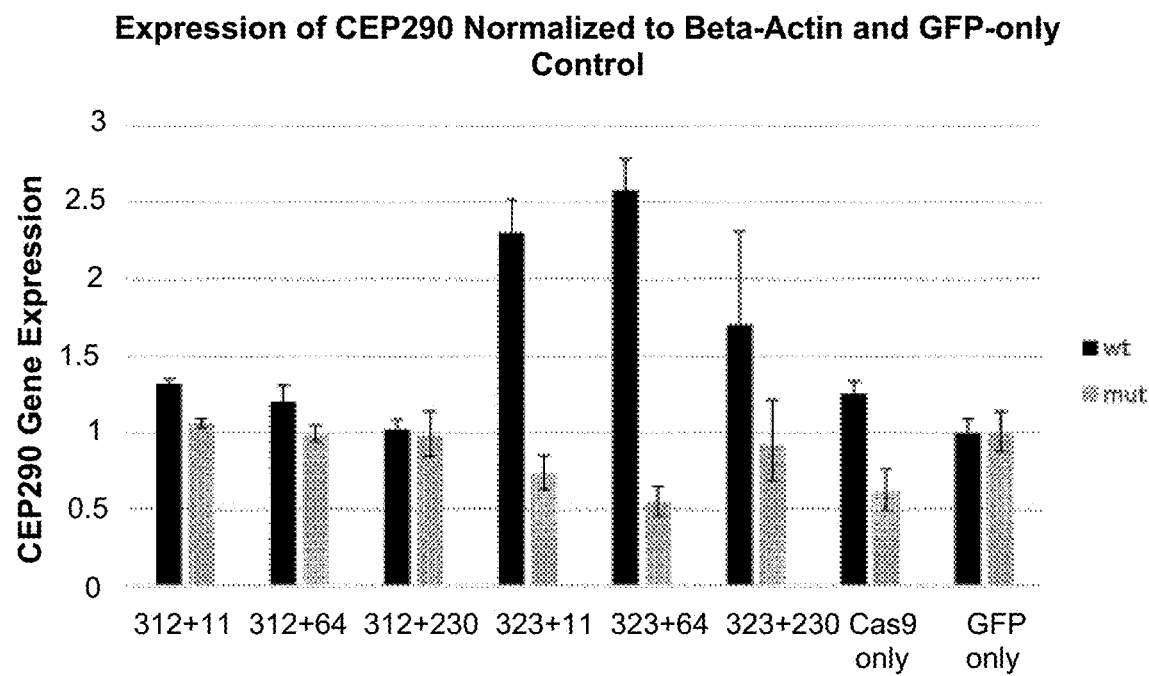
FIGS. 12A-12B show changes in expression of the wild-type and mutant (including cryptic exon) alleles of CEP290 in cells transfected with Cas9 and the indicated gRNA pairs. Total RNA was isolated from modified cells and qRT-PCR with Taqman primer-probe sets was used to quantify expression. Expression is normalized to the Beta-Actin housekeeping gene and each sample is normalized to the GFP control sample (cells transfected with only GFP). Error bars represent standard deviation of 4 technical replicates.
Figure 12B:
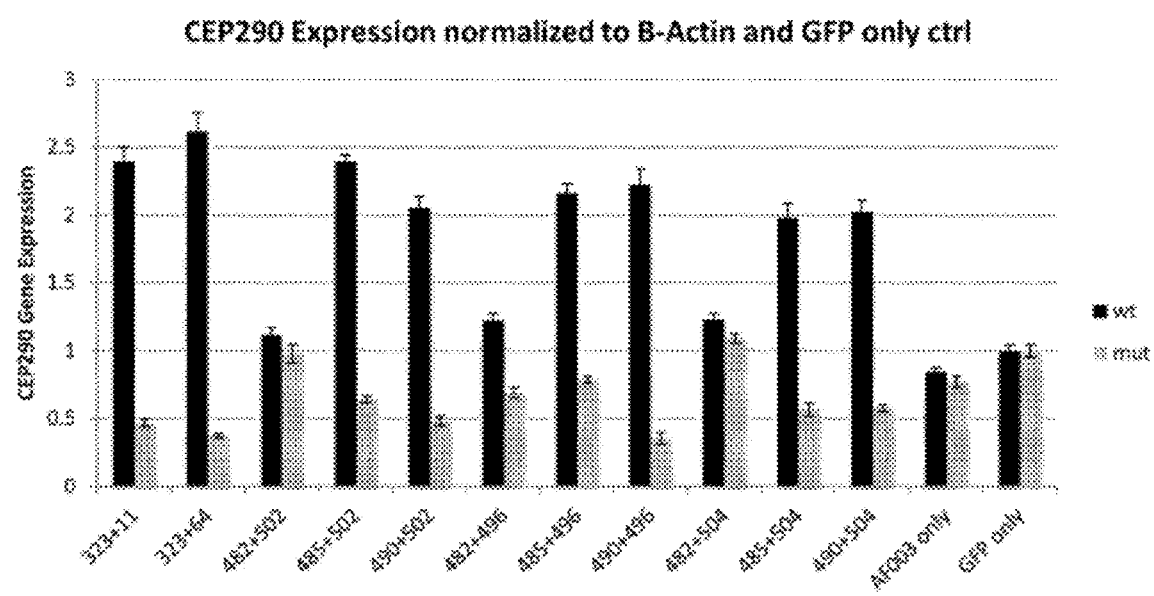
Figure 13:
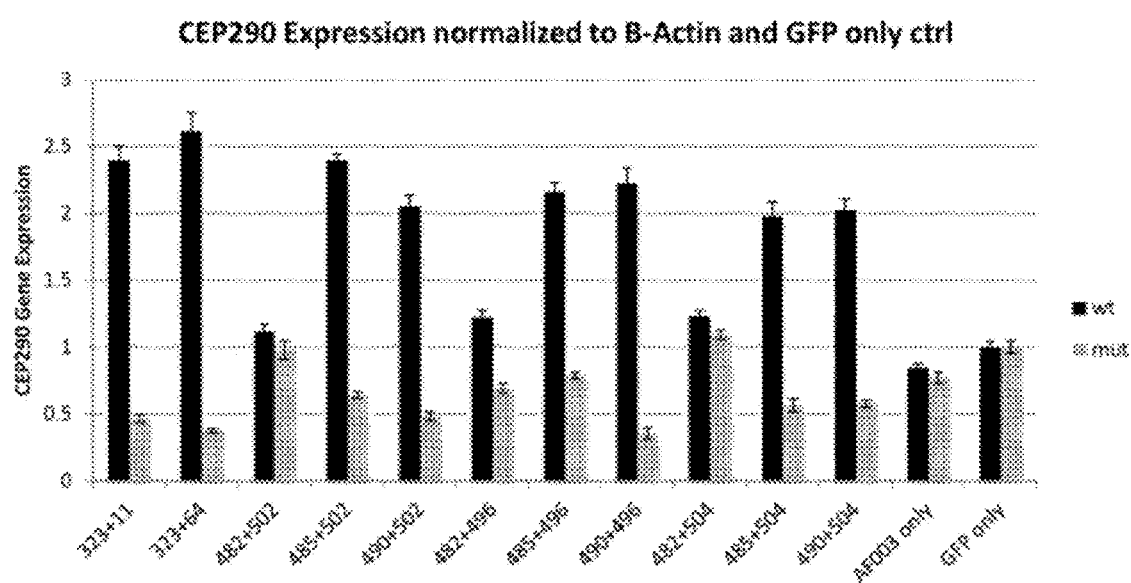
FIG. 13 shows changes in gene expression of the wild-type and mutant (including cryptic exon) alleles of CEP290 in cells transfected with Cas9 and pairs of gRNAs shown to have in initial qRT-PCR screening. Total RNA was isolated from modified cells and qRT-PCR with Taqman primer-probe sets was used to quantify expression. Expression is normalized to the Beta-Actin housekeeping gene and each sample is normalized to the GFP control sample (cells transfected with only GFP). Error bars represent standard error of the mean of two to six biological replicates.

Targeted deletion of a region containing the IVS26 splice mutation is predicted to correct the splicing defect and restore expression of the normal wild-type CEP290 allele. To quantify expression of the wild-type and mutant (containing additional cryptic splice mutation) alleles, TaqMan assays were designed. Multiple assays were tested for each RNA species and a single wt and single mutant assay were selected. The assay for the wild-type allele contains a forward primer that anneals in exon 26, a reverse primer that anneals in exon 27 and a TaqMan probe that spans the exon26-exon-27 junction. The assay for the mutant allele contains a forward primer that anneals in exon 26, a reverse primer that anneals in the cryptic exon and a TaqMan probe that spans the exon26-cryptic exon junction. A TaqMan assay designed to beta-actin was used as a control. Total RNA was isolated from IVS26 cells transfected with pairs of gRNAs and Cas9-expressing plasmid by either Trizol RNA purification (Ambion), Agencourt RNAdvance (Beckman Coulter) or direct cells-to-Ct lysis (Life Technologies). Reverse transcription to generate cDNA was performed and cDNA was used as a template for qRT-PCR using selected taqman assays on a BioRad real time PCR machine. Relative gene expression was calculated by ΔΔCt, relative to beta-actin control and GFP-only sample. Increases in expression of wt allele and decreases in expression of mutant allele relative to GFP-only control indicate corrected splicing due to gene targeting. FIGS. 12A-12B show initial qRT-PCR data for pairs of gRNAs that had shown activity as either individual gRNAs (measured as described in Example 3) or as pairs (measured as described in Example 4). Pairs of gRNAs that showed the desired gene expression changes were repeated in replicate experiments and the cumulative qRT-PCR data is shown in FIG. 13 (error bars represent standard error of the mean calculated from 2 to 6 biological replicates per sample).

Example 6: Quantification of Genomic Deletions by ddPCR

Figure 14:
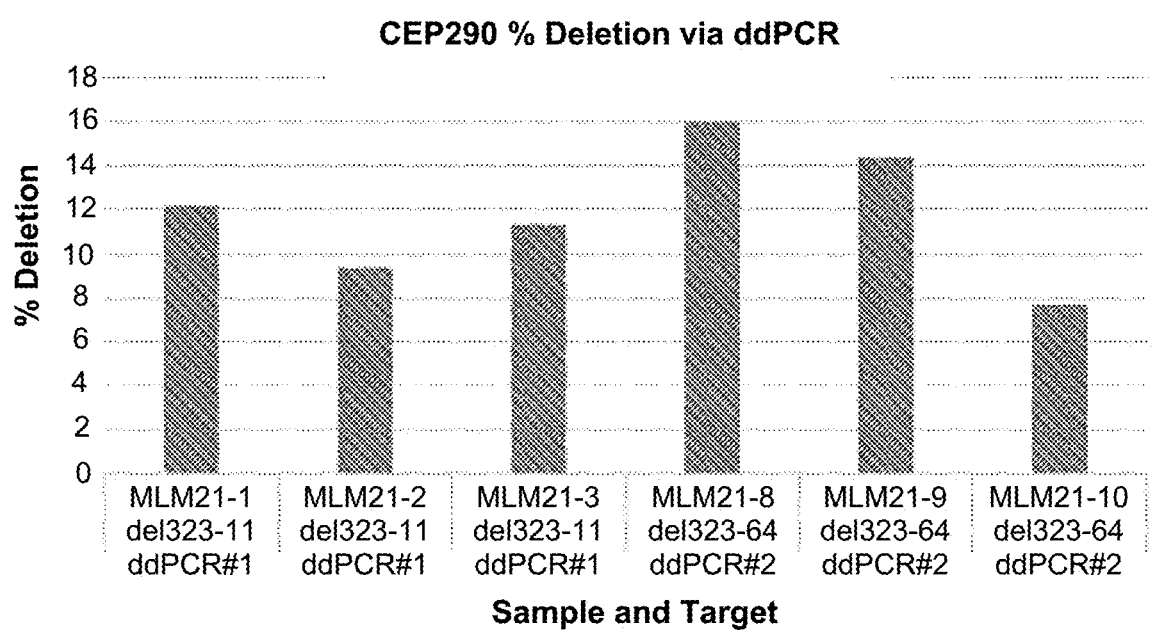
FIG. 14 shows deletion rates in cells transfected with indicated gRNA pairs and Cas9 as measured by droplet digital PCR (ddPCR). % deletion was calculated by dividing the number of positive droplets in deletion assay by the number of positive droplets in a control assay. Three biological replicates are shown for two different gRNA pairs.

Droplet digital PCR (ddPCR) is a method for performing digital PCR in which a single PCR reaction is fractionated into 20,000 droplets in a water-oil emulsion and PCR amplification occurs separately in individual droplets. PCR conditions are optimized for a concentration of DNA template such that each droplet contains either one or no template molecules. Assays were designed to perform amplification using BioRad EvaGreen Supermix PCR system with all amplicons ranging in size from 250-350 bp. Control assays were designed to amplify segments of the CEP290 gene at least 5 kb away from the IVS26 c.2991+1655A to G mutation. Assays to detect targeted genomic deletion were designed such that amplification of an allele that has undergone deletion will yield a PCR product in the size range of 250-350 bp and amplification will not occur on a wild-type allele due to the increased distance between forward and reverse primers. PCR conditions were optimized on genomic DNA isolated from 293 cells that had been transfected with pairs of gRNAs and Cas9-expressing plasmid. Deletion assays were verified to generate no positive signal on genomic DNA isolated from unmodified IVS26 fibroblasts. Assays were further tested and optimized on genomic DNA isolated from IVS26 fibroblasts that had been transfected with pairs of gRNAs and Cas9-encoding plasmid. Of the three assays tested for each of two deletions (CEP290-323 and CEP290-11; and CEP290-323 and CEP290-64) and the 4 control assays tested, a single assay was selected for each deletion and a control based on quality data and replicability in the ddPCR assay. FIG. 14 shows deletion rates on three biological replicates calculated by taking the number of positive droplets for the deletion assay and dividing by the number of positive droplets for the control assay.

Example 7: Cloning AAV Expression Vectors

Cloning saCas9 into an AAV Expression Vector

The pAF003 plasmid encodes the CMV-driven *S. aureus* Cas9 (saCas9), with N-terminal and C-terminal nuclear localization signals (NLS) and a C-terminal triple flag tag, followed by a bovine growth hormone poly(A) tail (bGH polyA). BGH polyA tail was substituted with a 60-bp minimal polyA tail to obtain pAF003-minimal-pA. The CMV-driven NLS-saCas9-NLS-3×Flag with the minimal polyA tail was amplified with PCR and subcloned into pTR-UF11 plasmid (ATCC #MBA-331) with KpnI and SphI sites to obtain the pSS3 (pTR-CMV-saCas9-minimal-pA) vector. The CMV promoter sequence can be substituted with EFS promoter (pSS10 vector), or tissue-specific promoters (Table 20, e.g. photo-receptor-specific promoters, e.g. Human GRK1, CRX, NRL, RCVRN promoters, etc.) using SpeI and NotI sites.

Constructing the All-In-One AAV Expression Vector with One gRNA Sequence

For each individual gRNA sequence, a STITCHR product with a U6 promoter, gRNA, and the gRNA scaffold was obtained by PCR with an oligonucleotide encoding the gRNA sequence. The STITCHR product with one dsDNA molecule of U6-driven gRNA and scaffold was subcloned into pSS3 or pSS10 vectors using KpnI sites flanking the STITCHR product and downstream of the left Inverted Terminal Repeat (ITR) in the AAV vectors. The orientation of the U6-gRNA-scaffold insertion into pSS3 or pSS10 was determined by Sanger sequencing. Alternate promoters may be used to drive gRNA expression (e.g. H1 promoter, 7SK promoter). Any gRNA scaffold sequences compatible with Cas variants from other bacterial species could be incorporated into STITCHR products and the AAV expression vector therein.

Cloning Two gRNA into an AAV Expression Vector

For each pair of gRNA sequences, two ssDNA oligonucleotides were designed and obtained as the STITCHR primers, i.e. the left STITCHR primer and the right STITCHR primer. Two STITCHR PCR reactions (i.e. the left STITCHR PCR and the right STITCHR PCR) amplified the U6 promoter and the gRNA scaffold with the corresponding STITCHR primer separately. The pSS3 or pSS10 backbone was linearized with KpnI restriction digest. Two dsDNA STITCHR products were purified and subcloned into pSS3 or pSS10 backbone with Gibson Assembly. Due to the unique overlapping sequences upstream and downstream of the STITCHR products, the assembly is unidirectional. The sequences of the constructs were confirmed by Sanger Sequencing. Table 24 lists the names and compositions of AAV expression vectors constructed, including the names of gRNAs targeting human CEP290, the promoter to drive Cas9 expression, and the length of the AAV vector including the Inverted Terminal Repeats (ITRs) from wild type AAV2 genome. Alternative promoters (e.g., H1 promoter or 7SK promoter) or gRNA scaffold sequences compatible with any Cas variants could be adapted into this cloning strategy to obtain the corresponding All-in-One AAV expression vectors with two gRNA sequences.

TABLE 24

Components of AAV expression vectors

| Name | Left gRNA | Right gRNA | Promoter of saCas9 | Length including ITRs |
| --- | --- | --- | --- | --- |
| pSS10 | NA | NA | EFS | 4100 |
| pSS11 | CEP290-64 | CEP290-323 | EFS | 4853 |
| pSS15 | CEP290-64 | NA | EFS | 4491 |
| pSS17 | CEP290-323 | NA | EFS | 4491 |
| pSS30 | CEP290-323 | CEP290-64 | EFS | 4862 |
| pSS31 | CEP290-323 | CEP290-11 | EFS | 4862 |
| pSS32 | CEP290-490 | CEP290-502 | EFS | 4858 |
| pSS33 | CEP290-490 | CEP290-496 | EFS | 4858 |
| pSS34 | CEP290-490 | CEP290-504 | EFS | 4857 |
| pSS35 | CEP290-492 | CEP290-502 | EFS | 4858 |
| pSS36 | CEP290-492 | CEP290-504 | EFS | 4857 |
| pSS3 | NA | NA | CMV | 4454 |
| pSS8 | CEP290-64 | CEP290-323 | CMV | 5207 |
| pSS47 | CEP290-323 | CEP290-64 | CMV | 5216 |
| pSS48 | CEP290-323 | CEP290-11 | CMV | 5216 |
| pSS49 | CEP290-490 | CEP290-502 | CMV | 5212 |
| pSS50 | CEP290-490 | CEP290-496 | CMV | 5212 |
| pSS51 | CEP290-490 | CEP290-504 | CMV | 5211 |
| pSS52 | CEP290-492 | CEP290-502 | CMV | 5212 |
| pSS53 | CEP290-492 | CEP290-504 | CMV | 5211 |
| pSS23 | NA | NA | hGRK1 | 4140 |
| pSS24 | NA | NA | hCRX | 3961 |
| pSS25 | NA | NA | hNRL | 4129 |
| pSS26 | NA | NA | hRCVRN | 4083 |

Example 8: Assessment of the Functions of All-In-One AAV Expression Vectors

Figure 15:
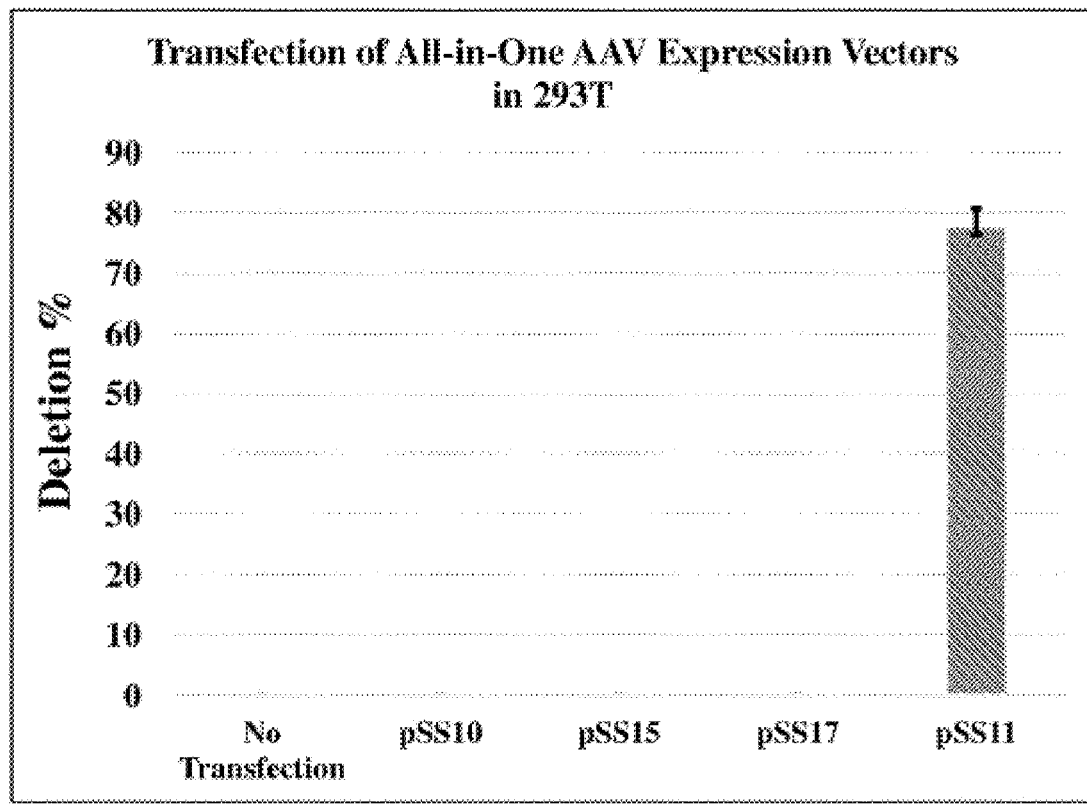
FIG. 15 shows deletion rates in 293T cells transfected with exemplary AAV expression plasmids. pSS10 encodes EFS-driven saCas9 without gRNA. pSS15 and pSS17 encode EFS-driven saCas9 and one U6-driven gRNA, CEP290-64 and CEP290-323 respectively. pSS11 encodes EFS-driven saCas9 and two U6-driven gRNAs, CEP290-64 and CEP290-323 in the same vector. Deletion PCR were performed with gDNA exacted from 293T cells post transfection. The size of the PCR amplicons indicates the presence or absence of deletion events, and the deletion ratio was calculated.

Each individual AAV expression vectors were transfected into 293T cells with TransIT-293 (Mirus, Inc.) to test their function before being packaged into AAV viral vectors. 293T cells were transfected with the same amount of plasmid and harvested at the same time points. SaCas9 protein expression was assessed by western blotting with primary antibody probing for the triple Flag tag at the C-terminus of saCas9, while loading control was demonstrated by αTubulin expression. Deletion events at IVS26 mutation could be determined by PCR amplification followed by Sanger sequencing or ddPCR. The results are shown in FIG. 15.

Example 9: Production, Purification and Titering of Recombinant AAV2 Vectors

Figure 16:
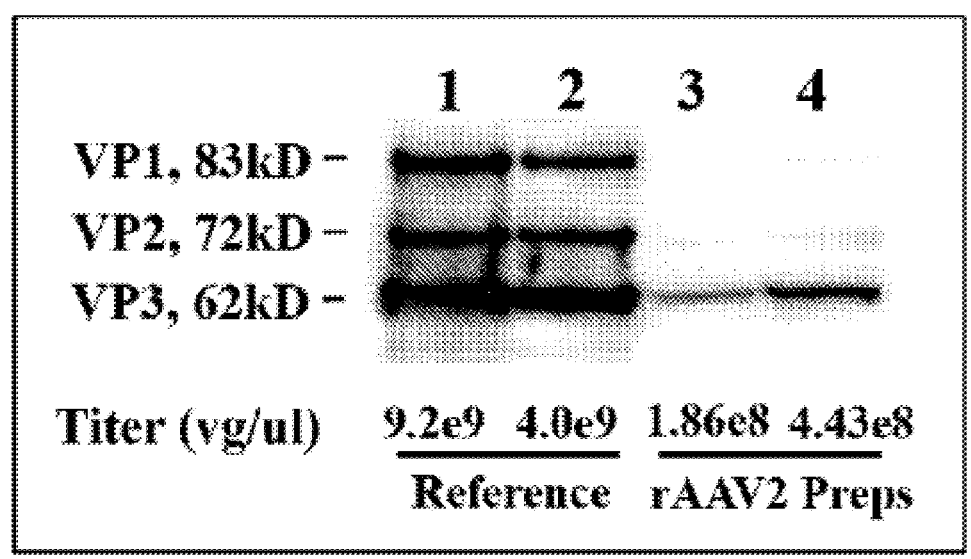
FIG. 16 shows the composition of structural proteins in AAV2 viral preps expressing Cas9. Reference AAV2 vectors (lanes 1 & 2) were obtained from Vector Core at University of North Carolina, Chapel Hill. AAV2-CMV-GFP (lane 3) and AAV2-CMV-saCas9-minpA (lane4) were packaged and purified with "Triple Transfection Protocol" followed by CsCl ultracentrifugation. Titers were obtained by quantitative PCR with primers annealing to the ITR structures on these vectors. Viral preps were denatured and probed with B1 antibody on Western Blots to demonstrate three structural proteins composing AAV2, VP1, VP2, and VP3 respectively.

Prior to packaging into AAV viral vectors, all AAV expression vector (plasmids) underwent primer walk with Sanger sequencing and function analysis. In recombinant AAV (rAAV), two ITRs flanking the transgene cassettes are the only cis-acting elements from the wild-type AAV. They are critical for packaging intact rAAVs and genome-release for rAAV vectors during transduction. All AAV expression vectors were restriction digested with SmaI or XmaI to ensure the presence of two intact ITRs.

rAAV2 vectors were produced with "Triple Transfection Protocol": (1) pSS vectors with ITRs and transgene cassettes; (2) pHelper plasmid with E2A, E4, VA genes from Adenovirus; (3) pAAV-RC2 plasmid with Rep and Cap genes from AAV2. These three plasmids were mixed at a mass ratio of 3:6:5 and transfected into HEK293 with polymer or lipid-based transfection reagent (e.g. PEI, PEI max, Lipofectamine, TransIT-293, etc.). 60-72 hours post-transfection, HEK293 cells were harvested and sonicated to release viral vectors. Cell lysates underwent CsCl ultracentrifuge to purify and concentrate the viral vectors. Additional purification procedures were performed to obtain higher purity for biophysical assays, including another round of CsCl ultracentrifuge, or sucrose gradient ultracentrifuge, or affinity chromatography. Viral vectors were dialyzed with 1×DPBS twice before being aliquoted for storage in −80° C. Viral preps can be tittered with Dot-Blot protocol or/and quantitative PCR with probes annealing to sequences on the transgenes. PCR primer sequences are: AACATGC-TACGCAGAGAGGGAGTGG (SEQ ID NO: 399) (ITR-Titer-fwd) and CATGAGACAAGGAACCCCTAGTGATG-GAG (SEQ ID NO: 400) (ITR-Titer-rev). Reference AAV preps were obtained from the Vector Core at University of North Carolina-Chapel Hill as standards. To confirm the presence of three non-structural viral proteins composing the AAV capsid, viral preps were denatured and probed with anti-AAV VP1/VP2/VP3 monoclonal antibody B1 (American Research Products, Inc. Cat #03-65158) on western blots. The results are shown in FIG. 16.

Figure 17:
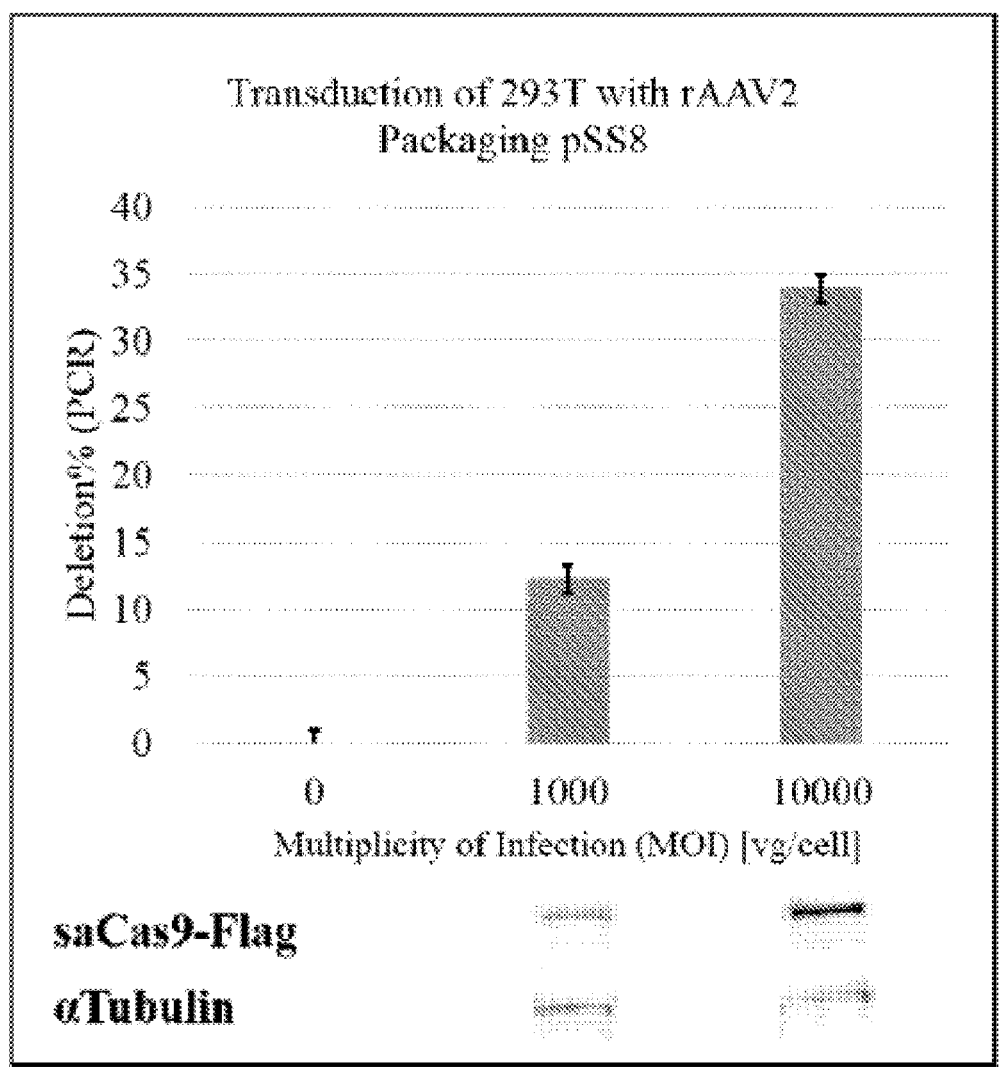
FIG. 17 depicts the deletion rates in 293T cells transduced with AAV viral vectors at MOI of 1000 viral genome (vg) per cell and 10,000 vg per cell. AAV2 viral vectors were produced with "Triple Transfection Protocol" using pHelper, pRep2Cap2, pSS8 encoding gRNAs CEP290-64 and CEP290-323, and CMV-driven saCas9. Viral preps were titered with primers annealing to ITRs on pSS8. 6 days post transduction, gDNA were extracted from 293T cells. Deletion PCR was carried out on the CEP290 locus, and deletion rates were calculated based on the predicted amplicons. Western blotting was carried out to show the AAV-mediated saCas9 expression in 293T cells (primary antibody: anti-Flag, M2; loading control: anti-alphaTubulin).

Example 10: rAAV-Mediated CEP290 Modification In Vitro 293T were transduced with rAAV2 vectors expressing saCas9 with or without gRNA sequences to demonstrate the deletion events near the IVS26 splicing mutant. 293T cells were transduced with rAAV2 viral vectors at an MOI of 1,000 viral genome (vg)/cell or 10,000 vg/cell and harvested at three to seven days post transduction. Western blotting with the primary antibody for Flag (anti-Flag, M2, Sigma-Aldrich) showed that the presence of U6-gRNA-scaffold does not interfere with saCas9 expression. Genomic DNA from 293T was isolated with the Agencourt DNAdvance Kit (Beckman Coulter). Regions including the deletions were PCR amplified from genomic DNA isolated, and analyzed on the QIAxcel capillary electrophoresis machine. Amplicons smaller than the full-length predicted PCR products represent the deletion events in 293T cells. The PCR results are shown in FIG. 17. To further understand the nature of these deletion events, PCR products were cloned into Zero-Blunt TOPO Cloning Kit (Life Technologies) and transformed into chemically competent Top10 cells. Bacterial colonies were then cultured and sequenced using Sanger sequencing. Sequence results were aligned with the wt CEP290 locus for analysis.

Figure 27A:
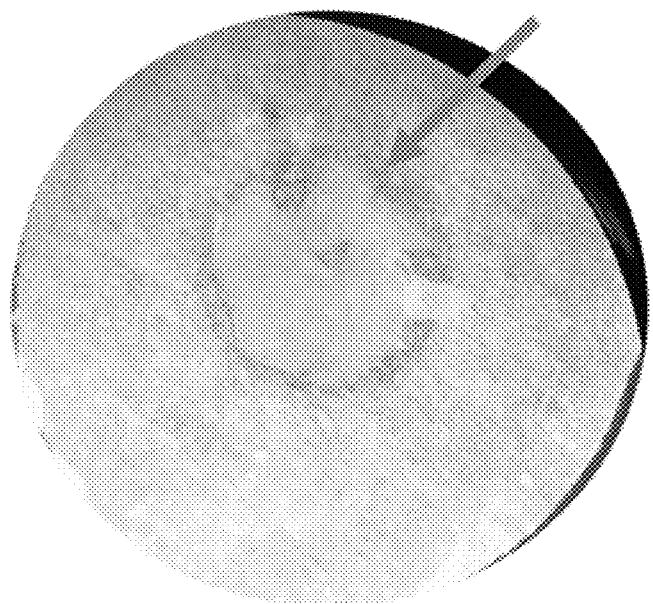
FIG. 27A shows a photomicrograph of a mouse retinal explant on a support matrix; retinal tissue is indicated by the arrow.
Figure 27B:
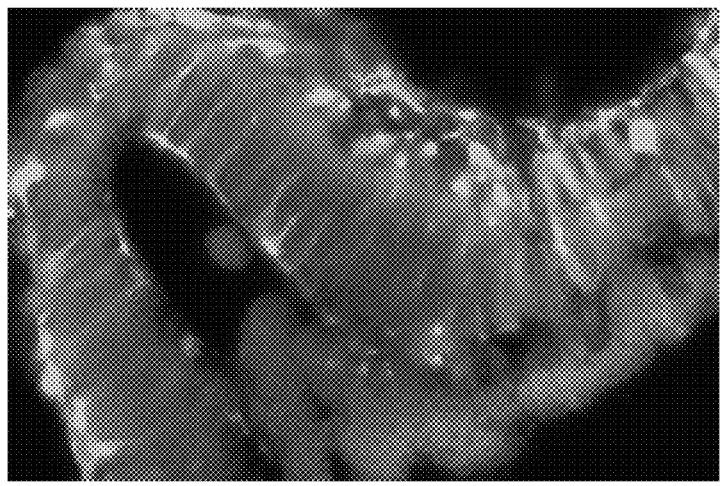
FIG. 27B shows a fluorescence micrograph from a histological section of a mouse retinal explant illustrating AAV transduction of cells in multiple retinal layers with a GFP reporter.
Figure 28A:
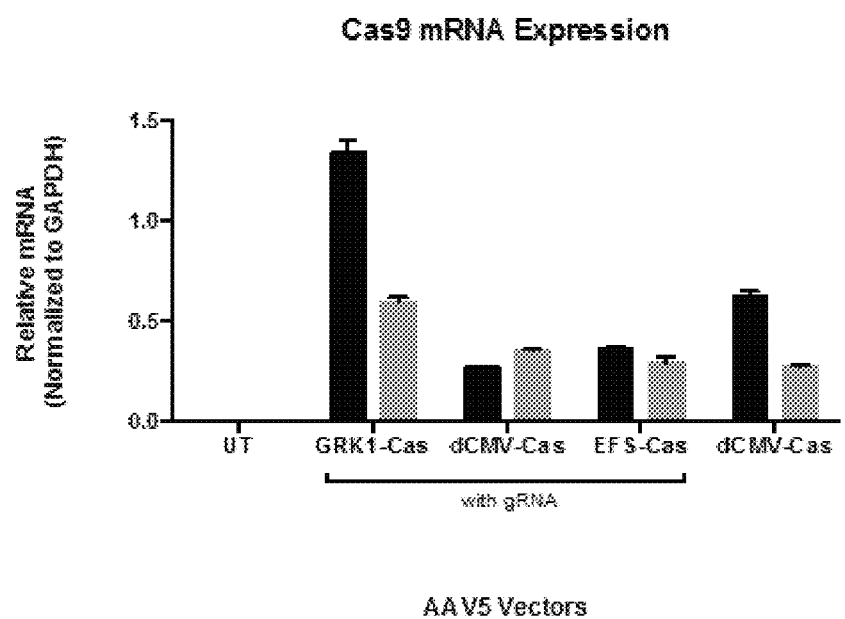
FIG. 28A and FIG. 28B show expression of Cas9 mRNA and gRNA, respectively, normalized to GAPDH mRNA expression. UT denotes untreated; GRK1-Cas refers to a vector in which Cas9 expression is driven by the photoreceptor-specific hGRK1 promoter; dCMV-Cas and EFS-Cas similarly refer to vectors in which Cas9 expression is driven by the dCMV promoter or the EFS promoter. Conditions in which gRNAs are included in the vector are denoted by the bar captioned "with gRNA." Light and dark bars depict separate experimental replicates.
Figure 28B:
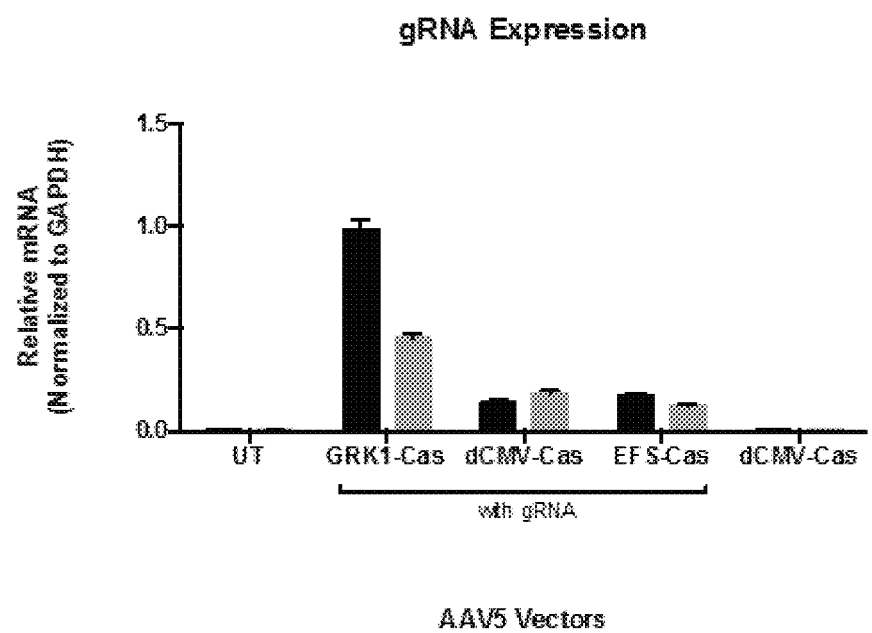

Example 11: AAV Transduction of Genome Editing Systems in Mouse Retinal Explants To assess the ability of the AAV vectors described above to transduce CRISPR/Cas9 genome editing systems into retinal cells in situ, an ex vivo explant system was developed. FIG. 27A shows a representative image of an explanted mouse retina on a support matrix, with the tissue indicated by the gray arrow. Explants were harvested at 7- or 10-day time points, and histological, DNA, RNA and/or protein samples were produced. FIG. 27B shows a representative fluorescence micrograph from a retinal explant treated with an AAV vector carrying a GFP reporter, demonstrating successful transduction of an AAV payload in cells in multiple layers of the retina.

mRNA samples taken from retinal explants further demonstrate that genome editing systems according to the present disclosure are effectively transduced by these AAV vectors: FIG. 28A and FIG. 28B show expression of Cas9 mRNA and gRNA, respectively, normalized to the expression of GAPDH. As expected, untreated samples did not express Cas9 or gRNA, and gRNA was not detected in samples that were not transduced with gRNA coding sequences. Cas9 expression was observed in three AAV constructs in which Cas9 expression was driven by hGRK1, CMV or EFS promoters. The observation of Cas9 mRNA and gRNA in samples transduced with vectors in which Cas9 expression is driven by the retinal photoreceptor cell specific hGRK1 promoter indicates that these vectors can transduce genome editing systems in photoreceptor cells in situ.

DNA samples from retinal explants treated with AAV vectors were sequenced, and indel species were identified. The AAV vectors used in the mouse explant system included guides with targeting domains specific to the mouse CEP290 gene but targeted to the same region of intron 26 as the human guides presented above; aside from the specific guide sequences used, the AAV vectors used were the same as those described above. Table 30 shows a wild type (WT) mouse sequence, with left and right guide sequences italicized, and three representative indels of +1, −4 and −246 aligned with the WT sequence. In the table, three periods ( ... ) represent an abbreviation of the sequence read for ease of presentation, while dashes (-) represent alignment gaps and underlined nucleotides represent insertions. Insofar as DNA sequencing of explants treated with AAV vectors utilizing the photoreceptor specific hGRK1 promoter revealed indel formation, these data demonstrate genome editing of a CEP290 target site in retinal photoreceptors.

TABLE 30

Representative Indels in Mouse Retinal Explants

```
WT    CCCTCAAACACATGTCTCACGCAGCTTAGACATTCT...CAGAACTCGGTCAG-CATGCTACAGATAGCTTATCT
              (SEQ ID NO: 2788)                      (SEQ ID NO: 2789)

+1   CCCTCAAACACATGTCTCACGCAGCTTAGACATTCT...CAGAACTCGGTCAGGCATGCTACAGATAGCTTATCT
              (SEQ ID NO: 2788)                      (SEQ ID NO: 2790)

-4   CCCTCAAACACATGTCTCACGCAGCTTAGACATTCT...CAGAACTCGG-----CATGCTACAGATAGCTTATCT
              (SEQ ID NO: 2788)                      (SEQ ID NO: 2791)

-246 CCCTCAAAG---------------------------...---------------CATGCTACAGATAGCTTATCT
              (SEQ ID NO: 2792)                      (SEQ ID NO: 2793)
```

Figure 29:
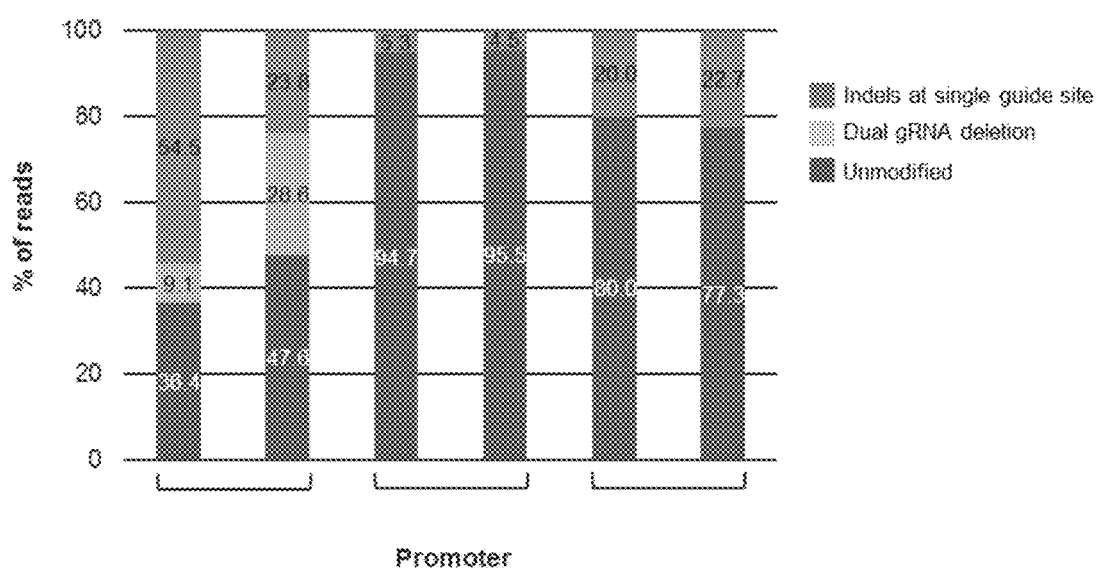
FIG. 29 summarizes the edits observed in mouse retinal explants 7 days after transduction with AAV5-mCEPgR-NAs-Cas9. Edits were binned into one of three categories: no edit, indel at one of two guide sites, and deletion of sequence between the guide sites. Each bar graph depicts the observed edits as a percentage of sequence reads from individual explants transduced with AAV vectors in which Cas9 was driven by the promoter listed (hGRK1, CMV or EFS).

FIG. 29 summarizes the estimated frequencies of particular editing events in individual mouse explants transduced with AAV vectors according to the present disclosure. In samples transduced with AAV vectors in which Cas9 expression was driven by the hGRK1 promoter, deletions of sequences between gRNAs (guide sites) were consistently observed, as were indels at one of the two guide sites. Indels at one of the two guide sites were also observed in explants transduced with CMV and EFS vectors.

Taken together, these results demonstrate the transduction of CRISPR/Cas9 genome editing systems into cells, including photoreceptor cells, in the intact mouse retina and the editing (including deletion) of a CEP290 target site in retinal photoreceptors in situ.

Example 12: AAV Transduction of Genome Editing Systems in Primate Retina In Vivo To assess the ability of the AAV vectors described above to transduce CRISPR/Cas9 genome editing systems into retinal cells in vivo, a primate subretinal injection procedure was developed. Cynomolgus macaques received a bilateral subretinal injections of an AAV5 vector encoding S. aureus Cas9 operably linked to an EFS, CMV or hGRK promoter sequence, and gRNAs C1 and C2, targeted to an intronic region of the cynomolgus CEP290 gene and comprising targeting sequences as set forth in SEQ ID NOs: 2794 and 2796 respectively (see Table 31). AAV injections were given at dosages of $4 \times 10^{10}$ (low) or $4 \times 10^{11}$ (high) viral genomes (vg). Experimental conditions are summarized in Table 32.

TABLE 31

Cynomolgus gRNA Targeting Domain Sequences

| Guide | Targeting Domain Sequence (DNA) | Targeting Domain Sequence (RNA) |
|---|---|---|
| C1 | GGCCGGCTAATTTAGTAGAGA (SEQ ID NO: 2794) | GGCCGGCUAAUUUAGUAGAGA (SEQ ID NO: 2795) |
| C2 | GTTATGAAGAATAATACAAA (SEQ ID NO: 2796) | GUUAUGAAGAAUAAUACAAA (SEQ ID NO: 2797) |

TABLE 32

Cynomolgus Treatment Conditions

| Group | Vector | Dose (vg/eye) |
|---|---|---|
| CMV-low | CEPgRNAs-dCMV-Cas9 | $4 \times 10^{10}$ |
| CMV-high | CEPgRNAs-dCMV-Cas9 | $4 \times 10^{11}$ |
| EFS-low | CEPgRNAs-EFS-Cas9 | $4 \times 10^{10}$ |
| EFS-high | CEPgRNAs-EFS-Cas9 | $4 \times 10^{11}$ |
| GRK-low | CEPgRNAs-GRK1-Cas9 | $4 \times 10^{10}$ |

TABLE 32-continued

Cynomolgus Treatment Conditions

| Group | Vector | Dose (vg/eye) |
|---|---|---|
| GRK-high | CEPgRNAs-GRK1-Cas9 | $4 \times 10^{11}$ |
| Vehicle | GRK1-GFP/Vehicle | $4 \times 10^{11}$ |

6 or 8 mm retinal tissue punches were obtained from AAV-treated and Vehicle-treated retinas at 6 and 13 weeks post injection, and genomic DNA was harvested. Sequencing was performed by using a proprietary methodology (Uni-Directional Targeted Sequencing, or UDiTaS) described in commonly assigned, U.S. Provisional Patent Application No. 62/443,212, which is incorporated by reference herein in its entirety. Data from two UDiTaS sequencing reactions with individual upstream or downstream primers was combined by assuming complete overlap of indels at the two different gRNA cut sites and by averaging the rates of inversions and deletions observed in the two sequencing reactions.

Figure 27C:
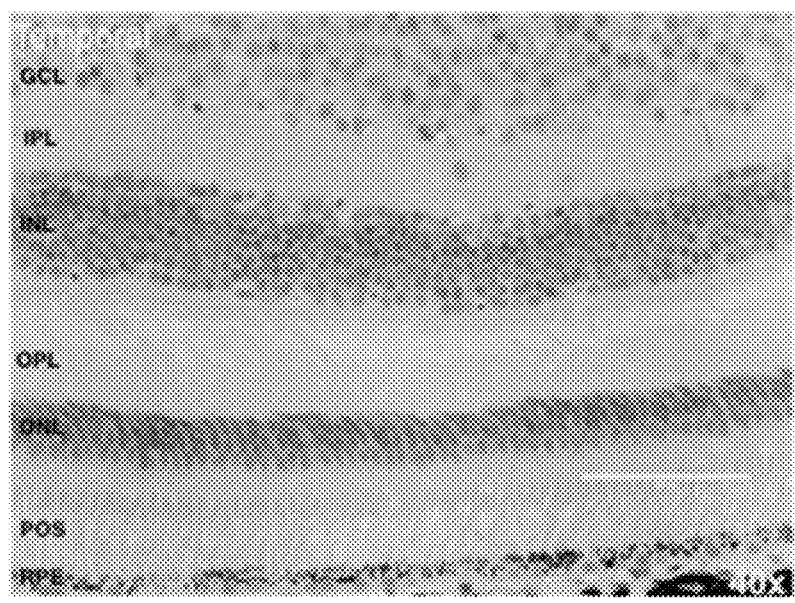
FIG. 27C shows a micrograph from a histological section of a primate retinal tissue treated with vehicle.
Figure 27D:
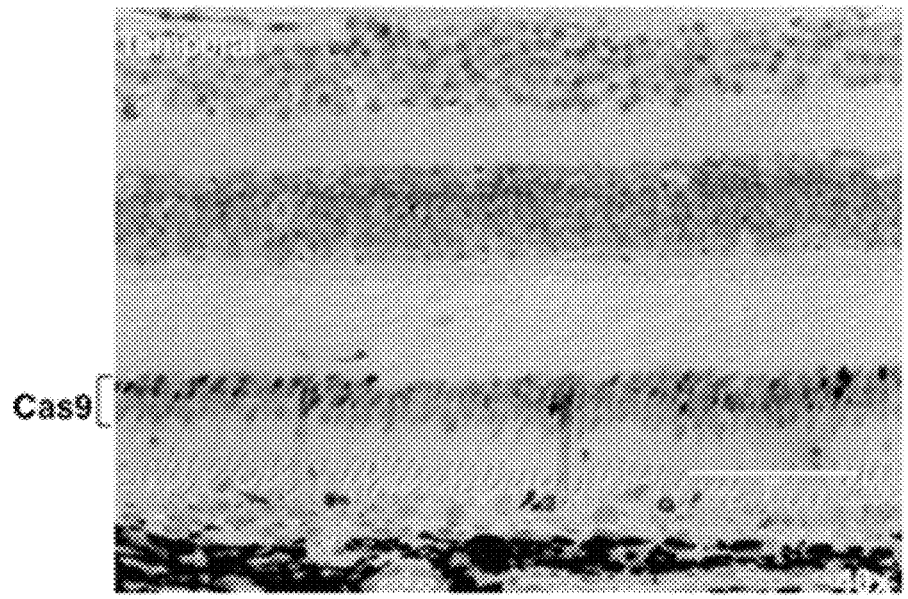
FIG. 27D shows a micrograph from a histological section of a primate retinal tissue treated with AAV5 vector encoding *S. aureus* Cas9 operably linked to the photoreceptor-specific hGRK1 promoter. Dark staining in the outer nuclear layer (ONL) indicates that cells were successfully transduced with AAV and express Cas9.

Histological analysis demonstrated successful transduction of primate photoreceptor cells using genome editing systems as disclosed herein. FIG. 27C depicts Cas9 antibody staining in a vehicle-control tissue punch from a primate retina, while FIG. 27D shows Cas9 expression in a punch from a primate retina treated with an AAV5 vector encoding S. aureus Cas9 operably linked to an hGRK promoter sequence. The figures show that the outer nuclear layer (ONL) in the AAV5 vector-treated punch contains Cas9 protein, while the ONL from the vehicle control punch does not. This demonstrates successful transduction of cells in this layer. No detectable Cas9 expression was detected in cells outside the ONL. Because the hGRK promoter is photoreceptor specific, these data indicate that the systems and methods of this disclosure result in Cas9 expression among retinal photoreceptor cells in primates.

Figure 30:
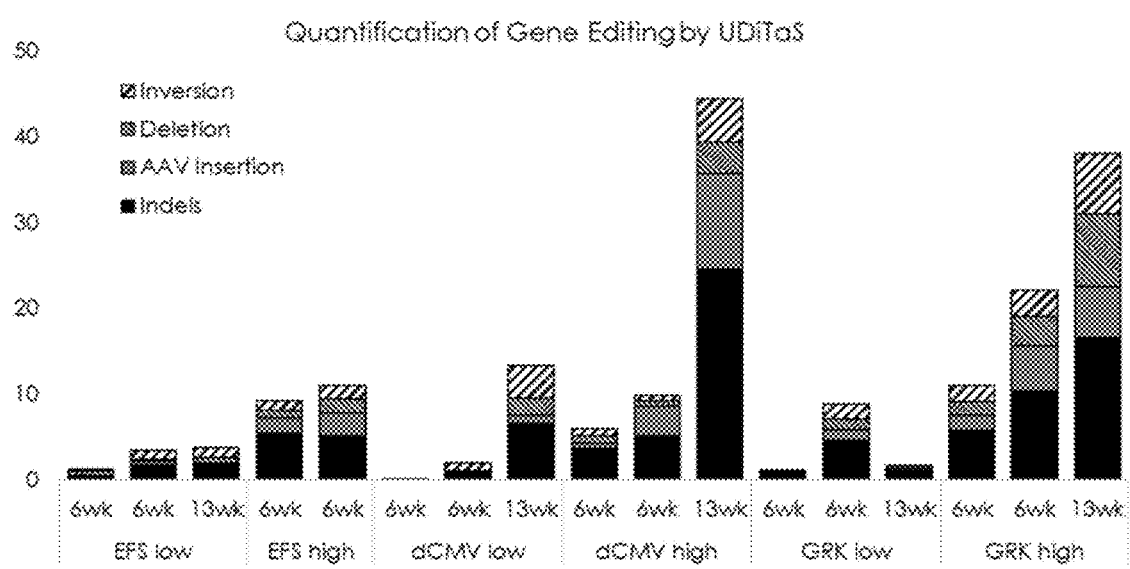
FIG. 30 summarizes the edits observed in the CEP290 gene in retinal punch samples obtained from cynomolgus monkeys treated with AAV vectors encoding genome editing systems according to the present disclosure.

FIG. 30 shows the frequency with which specific edits (indels, insertions, deletions and inversions, were observed in each condition. In both the CMV-high and GRK-high conditions, the frequency of editing events approached or exceeded 40% of reads at the 13-week timepoints. Frequencies of specific edits observed in each experimental condition at each timepoint are listed in Table 33, below. 13 weeks timepoints for the EFS-high condition were not obtained.

TABLE 33

Editing Frequencies Observed in Cynomolgus Treatment Conditions at 6 and 13 Weeks

| | | Total editing | Inversions | Deletions | Insertions | Indels |
|---|---|---|---|---|---|---|
| EFS-low | 6 week | 2.4% | 0.6% | 0.4% | 0.3% | 1.1% |
| | 13 week | 3.8% | 1.2% | 0.6% | 0.0% | 2.0% |
| EFS-high | 6 week | 10.2% | 1.4% | 1.3% | 2.3% | 5.3% |
| | 13 week | — | — | — | — | — |

TABLE 33-continued

Editing Frequencies Observed in Cynomolgus
Treatment Conditions at 6 and 13 Weeks

|  |  | Total editing | Inversions | Deletions | Insertions | Indels |
|---|---|---|---|---|---|---|
| CMV-low | 6 week | 1.1% | 0.5% | 0.0% | 0.1% | 0.5% |
|  | 13 week | 13.4% | 3.7% | 2.1% | 0.9% | 6.6% |
| CMV-high | 6 week | 8.0% | 0.7% | 0.7% | 2.1% | 4.4% |
|  | 13 week | 44.5% | 5.1% | 3.7% | 11.2% | 24.5% |
| GRK-low | 6 week | 5.0% | 0.9% | 0.7% | 0.7% | 2.7% |
|  | 13 week | 1.6% | 0.0% | 0.0% | 0.3% | 1.3% |
| GRK-high | 6 week | 16.6% | 2.5% | 2.5% | 3.5% | 8.1% |
|  | 13 week | 38.0% | 7.0% | 8.5% | 5.9% | 16.7% |

It should be noted that the hGRK1 promoter is photoreceptor specific, and that the genome editing system encoded by the AAV5 vector would only be functional in photoreceptor cells. It is reasonable to conclude, therefore, that the percentages of reads obtained from tissue punches, which include other retinal cell types, are lower than the percentages that would be observed in photoreceptor cells alone. Together, these data demonstrate transduction of a CRISPR/Cas9 system into a primate retina by subretinal injection of AAV, in vivo, and the generation of targeted alterations in a CEP290 gene sequence in primate photoreceptor cells in vivo.

Example 13: Correction of IVS26 Splicing Defect by Inversions and Deletions

Figure 31A:
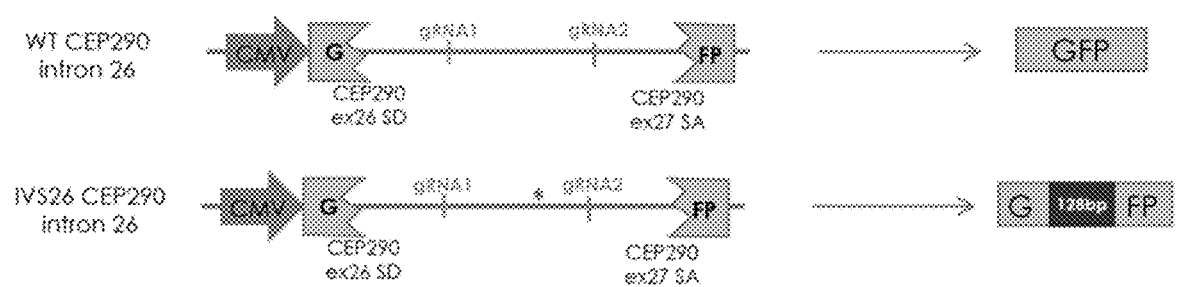
FIG. 31A depicts a reporter construct that was used to assess the effect of certain editing outcomes, including inversions and deletions, on the IVS26 splicing defect.
Figure 31B:
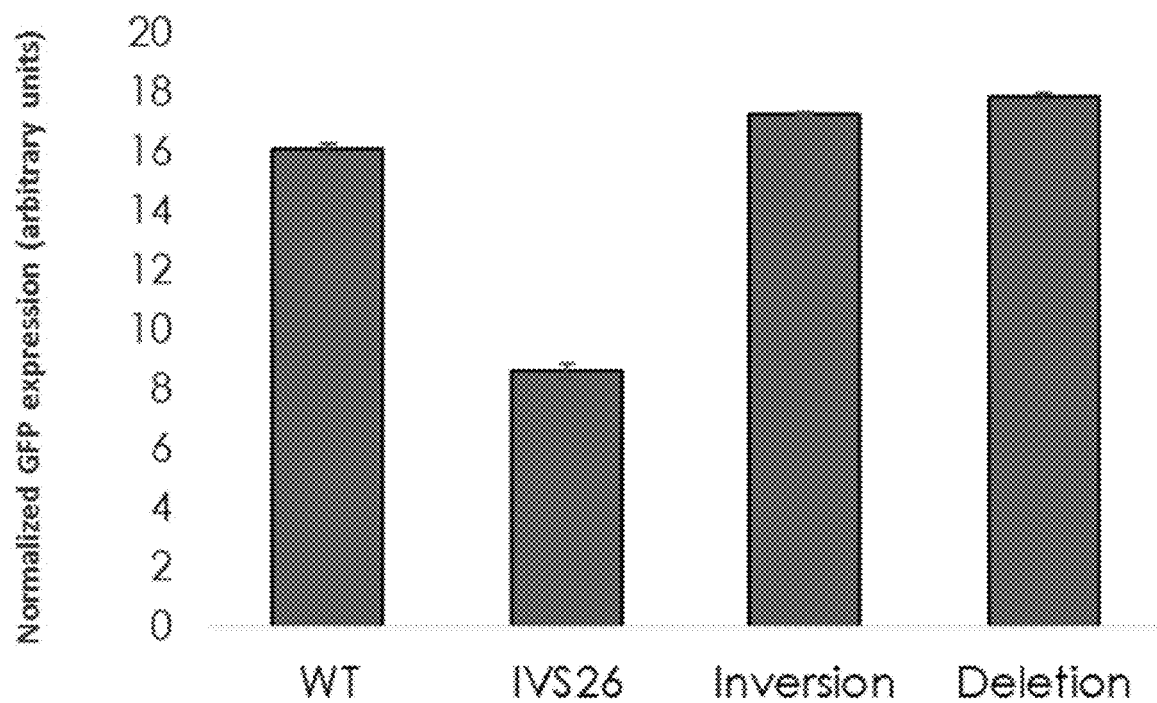
FIG. 31B depicts the relative levels of GFP reporter expression in WT, IVS26, deletion and inversion conditions, normalized to mCherry expression.

To verify that deletions and inversions of the intronic region including the IVS26 mutation correct the splicing defect observed in CEP290 associated disease, a reporter assay was developed utilizing four reporter constructs having the general design depicted in FIG. 31A:
pAD26_SplitGFP+WildType_CEP290_Kan (SEQ ID NO: 2798);
pAD27_SplitGFP+Mutant_CEP290_Kan (SEQ ID NO: 2799);
pAD28_SplitGFP+Mutant_CEP290_Inverted_Kan (SEQ ID NO: 2800); and
pAD29_SplitGFP+DeletionCEP290_Kan (SEQ ID NO: 2801). These constructs were transfected into U2OS cells at the concentrations shown in FIG. 31B, and GFP and mCherry expression was quantitated for each condition across three bioreplicates. Each of the four reporter constructs included a sequence encoding a split-green-fluorescent protein (GFP) reporter gene incorporating a 2217 bp human CEP 290 intron sequence corresponding to (a) wild type (WT), (b) the IVS26 mutation, (c) a deletion of the intronic sequence between two human CEP290 target sites, including the IVS26 mutation and the cryptic exon observed in mRNAs from subjects with CEP290 associated disease, as would result from the use of a genome editing system according to the present disclosure, or (d) an inversion of the intronic sequence between the two human CEP290 target sites, including the IVS26 mutation and the cryptic exon as would result from the use of a genome editing system of this disclosure. The construct is designed such that correct splicing is necessary for GFP expression. Thus, the presence of the cryptic splice acceptor site in the IVS26 condition, but not the WT condition, will result in disrupted GFP transcripts encoding non-functional GFP proteins; modifications at CEP290 target sites that result in the removal or alteration of the IVS26 mutation would rescue the expression of functional GFP protein. As shown in FIG. 31B, functional GFP protein is expressed at a high baseline level in cells treated with the WT construct, expression is reduced in the IVS26 condition, and is returned to the WT baseline level in the deletion and inversion conditions. These data indicate that the aberrant mRNA splicing caused by the IVS26 mutation is rescued by either deletion or inversion of the intronic sequence comprising that mutation.

Example 14: AAV5 Transduction of Genome Editing Systems in Human Retinal Explants To further establish that the genome editing systems of the present disclosure supported targeted gene editing in human retinal cells, e.g., fully mature human photoreceptors in situ, an ex vivo human retina explant system was developed. Purified AAV5 vectors were selected that encoded *S. aureus* Cas9 operably linked to an hGRK1 or CMV promoter sequence and first and second gRNAs comprising targeting sequences according to SEQ ID NOs: 389 and 388, respectively, and backbone sequences according to SEQ ID NO: 2787. As discussed above, these guides are targeted to the intronic region of the CEP290 gene on opposite sides of the IVS26 A>G mutation (Table 28). Human cadaver donor eyes were obtained within approximately 5 hours post-mortem and 3 mm punches were immobilized on a culture substrate as described above. Retinal explants were treated with AAV vectors at either a low dose of $1 \times 10^{11}$ vg or a high dose of $5 \times 10^{11}$ vg. Experimental conditions are summarized in Table 34.

TABLE 34

Human Treatment Conditions

| Group | Vector | Dose (vg/punch) |
|---|---|---|
| CMV-low | CEPgRNAs-dCMV-Cas9 | $1 \times 10^{11}$ |
| CMV-high | CEPgRNAs-dCMV-Cas9 | $5 \times 10^{11}$ |
| GRK-low | CEPgRNAs-GRK1-Cas9 | $1 \times 10^{11}$ |
| GRK-high | CEPgRNAs-GRK1-Cas9 | $5 \times 10^{11}$ |
| Vehicle | GRK1-GFP/Vehicle | $5 \times 10^{11}$ |

Figure 32:
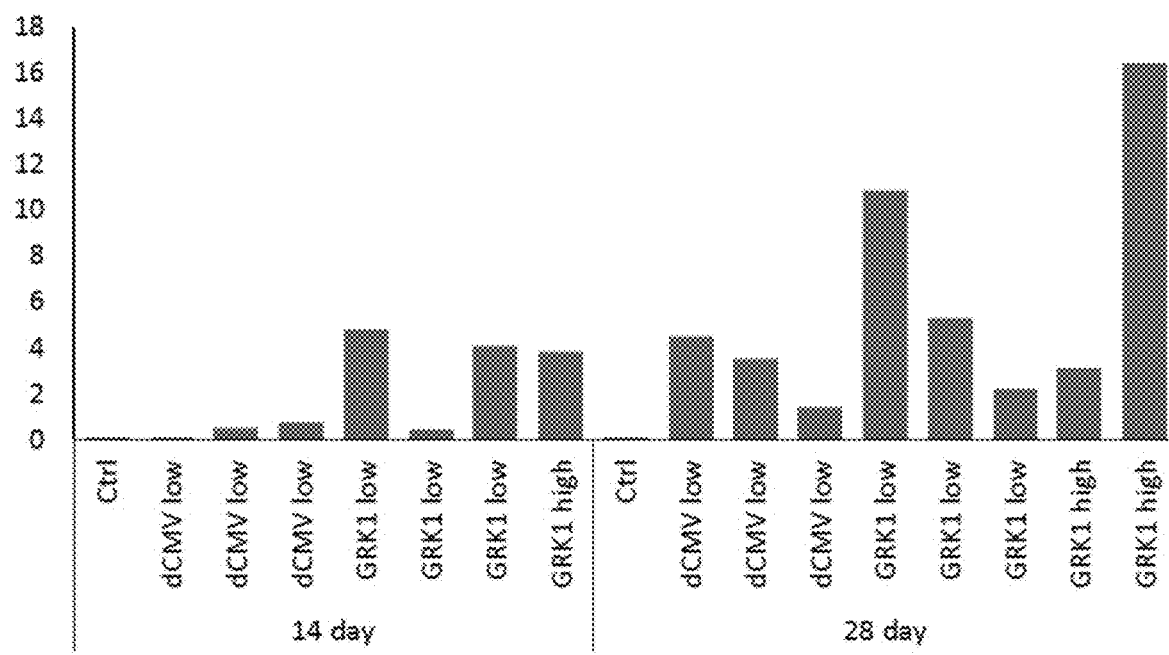
FIG. 32 summarizes the productive CEP290 edits observed in human retinal explants 14 or 28 days after transduction with AAV vectors in which Cas9 was driven by the promoter listed (hGRK1 or CMV).
Figure 33:
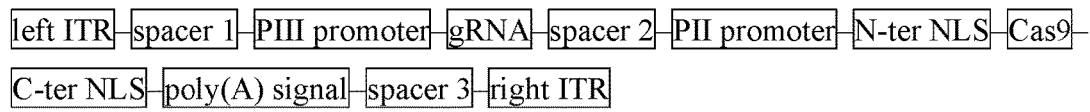
FIG. 33 shows components of a recombinant adenovirus-associated virus (AAV) genome.
Figure 34:
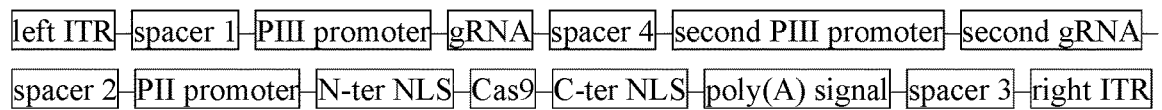
FIG. 34 shows components of a recombinant adenovirus-associated virus (AAV) genome.
Figure 35:
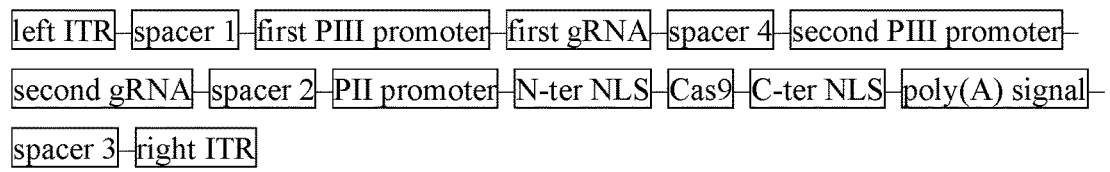
FIG. 35 shows components of a recombinant adenovirus-associated virus (AAV) genome.

DNA samples from human retinal explants treated with AAV vectors were sequenced at either 14 or 28 days post-transduction, and inversions and deletions were identified. FIG. 32 summarizes the productive editing observed in human retinal explants 14 and 28 days after transduction with the various AAV vectors. Productive editing was defined as total edits (equal to the sum of the rates of inversions and deletions) capable of correcting the LCA10-associated splice mutation in the CEP290 gene (FIG. 32). The most productive editing was observed at 16.4% at the 28 day time point for the GRK-high condition. These data demonstrate transduction of a CRISPR/Cas9 system into a human retina by subretinal injection of AAV and the generation of targeted alterations in a CEP290 gene sequence in human photoreceptor cells in situ.

Example 15: AAV5 Transduction of Genome Editing Systems in Live Transgenic IVS26 Knock-In Mice To further establish that the genome editing systems of the present disclosure supported targeted gene editing of the human CEP290 target position in mature photoreceptors in vivo, an IVS26 12 KI mouse model was employed. In this model, the human CEP290 exon 26, intron 26 with the IVS26 mutation (13 c.2991+1655A>G) and exon 27 have been inserted into the murine CEP290 gene via homologous recombination. AAV5 vectors encoding (i) *S. aureus* Cas9 operably linked to the photoreceptor-specific hGRK1 promoter sequence, and (ii) first and second gRNAs comprising targeting sequences according to SEQ ID NOs: 389 and 388, respectively, and having gRNA backbone sequences according to SEQ ID NO: 2787 were used as described in Example 14. The vectors were administered subretinally (toward the temporal side of the retina near the optic nerve) in both eyes of each animal at doses of $1\times10^{11}$ vg/mL, $1\times10^{12}$ vg/mL or $1\times10^{13}$ vg/mL; a vehicle group (containing BSS with 0.014% Tween20) was also used in the study as a control. Subretinal injections were conducted in anesthetized mice in accordance with NIH animal care guidelines. For each injection, a blunt-ended needle (33-gauge, 0.5 in; Hamilton company) on a 5 ml Hamilton syringe was inserted through the scleral incision, posterior to the lens, and was advanced centrally toward the temporal retina until resistance was felt. Care was taken to avoid the damaging the lens as the cannula was advanced. A volume of 1 microliter of AAV formulation or vehicle control containing 0.2 mg/mL of fluorescein was injected into the subretinal space, forming a bleb; fluorescein was used to visualize the bleb and to confirm successful injection. Animals were euthanized at 6- and 12-week timepoints, and retinal genomic DNA and RNA were isolated for determining the gene editing efficiency (by UDiTaS) and Cas9/gRNA levels (by RT_PCR), respectively.

Experimental conditions are summarized in Table 35, along with rates of insertion and deletion from individual retinas as measured by UDiTaS.

TABLE 35

Inversion and Deletion Rates in IVS26 KI Mouse Retinas

| | Dose | | | |
|---|---|---|---|---|
| | $1\times10^{12}$ vg | | $1\times10^{13}$ vg | |
| | Timepoint | | | |
| | 6 weeks | 12 weeks | 6 weeks | 12 weeks |
| Inversions | 4.68% | 3.91% | 2.06% | 1.88% |
| Deletions | 6.29% | 5.27% | 7.79% | 4.13% |

These data provide further demonstrate the successful transduction of retinal photoreceptor cells and alteration of the LCA10 target position using the vectors and genome editing systems of the present disclosure.

INCORPORATION BY REFERENCE

All publications, patents, and patent applications mentioned herein are hereby incorporated by reference in their entirety as if each individual publication, patent or patent application was specifically and individually indicated to be incorporated by reference. In case of conflict, the present application, including any definitions herein, will control.

EQUIVALENTS

Those skilled in the art will recognize, or be able to ascertain using no more than routine experimentation, many equivalents to the specific embodiments of the invention described herein. Such equivalents are intended to be encompassed by the following claims.

REFERENCES

1. Altschul et al. Nucleic Acids Res 25(17):3389-3402 (1977)
2. Altschul et al. J Mol Biol 215(3):403-410 (1990)
3. Ambati et al. Invest Ophthalmol Vis Sci 41(5):1181-1185 (2000a)
4. Ambati et al. Invest Ophthalmol Vis Sci 41(5):1186-1191 (2000b)
5. Anders et al. Nature 513(7519):569-573 (2014)
6. Baal et al. Am J Hum Genet 81(1):170-179 (2007)
7. Bae et al. Bioinformatics 30(10):1473-1475 (2014)
8. Bainbridge et al. N Engl J Med 358(21):2231-2239 (2008)
9. Briner et al. Mol Cell 56(2):333-339 (2014)
10. Chylinski et al. RNA Biol 10(5):726-737 (2013)
11. Cideciyan et al. Proc Natl Acad Sci USA 105(39):15112-15117 (2008)
12. Cong et al. Science 339(6121):819-823 (2013)
13. Coppieters et al. Hum Mutat 31(10):E1709-E1766 (2010)
14. Cornish-Bowden Nucleic Acids Res 13(9):3021-3030 (1985)
15. Davis & Maizels Proc Natl Acad Sci USA 111(10):E924-E932 (2014)
16. den Hollander et al. Am J Hum Genet 79(3):556-561 (2006)
17. den Hollander et al. Prog Retin Eye Res 27(4):391-419 (2008)
18. Deveau et al. J Bacteriol 190(4):1390-1400 (2008)
19. den Hollander et al. J Clin Invest 120(9):3042-3053 (2010)
20. Estrada-Cuzcano et al., Invest Ophthalmol Vis Sci. 52(2): 834-9, 2011
21. Esvelt et al. Nature 472(7344):499-503 (2011)
22. Fine et al. Sci Rep 5:10777 (2015)
23. Frit et al. DNA Repair (Amst.) 17:81-97 (2014)
24. Fu et al. Nat Biotechnol 32(3):279-284 (2014)
25. Haft et al. PLoS Comput Biol 1(6):e60 (2005)
26. Hauswirth et al. N Engl J Med 358(21):2240-2248 (2008)
27. Heigwer et al. Nat Methods 11(2):122-123 (2014)
28. Helou et al. J Med Genet 44(10):657-663 (2007)
29. Horvath et al. Science 327(5962):167-170 (2010)
30. Hou et al. Proc Natl Acad Sci USA 110(39):15644-15649 (2013)
31. Hsu et al. Nat Biotechnol 31(9):827-832 (2013)
32. Iyama & Wilson DNA Repair (Amst.) 12(8):620-636 (2013)
33. Jiang et al. Nat Biotechnol 31(3):233-239 (2013)
34. Jinek et al. Science 337(6096):816-821 (2012)
35. Jinek et al. Science 343(6176):1247997 (2014)
36. Karvelis et al. RNA Biol 10(5):841-851 (2013)
37. Kleinstiver et al. Nature 523(7561):481-485 (2015a)
38. Kleinstiver et al. Nat Biotechnol 33(12):1293-1298 (2015b)
39. Kleinstiver et al. Nature 529(7587):490-495 (2016)
40. Koenekoop et al. Clin Exp Ophthalmol 35(5):473-485 (2007)
41. Komor et al. Nature 533(7603):420-424 (2016)
42. Leber Archiv für Ophthalmologie (in German) 15(3):1-25 (1869)
43. Li Cell Res 18(1):85-98 (2008)
44. Littink et al. Invest Ophthalmol Vis Sci 51(7):3646-3652 (2010)
45. Maguire et al. N Engl J Med 358(21):2240-2248 (2008)
46. Maguire et al. Lancet 374(9701):1597-1605 (2009)
47. Makarova et al. Nat Rev Microbiol 9(6):467-477 (2011)
48. Mali et al. Science 339(6121):823-826 (2013)
49. Marteijn et al. Nat Rev Mol Cell Biol 15(7):465-481 (2014)
50. Myers & Miller Comput Appl Biosci 4(1):11-17 (1988)
51. Needleman & Wunsch J Mol Biol 48(3):443-453 (1970)
52. Nishimasu et al. Cell 156(5):935-949 (2014)
53. Nishimasu et al. Cell 162(5):1113-1126 (2015)
54. Pearson & Lipman Proc Natl Acad Sci USA 85(8):2444-2448 (1988)
55. Perrault et al. Hum Mutat 28(4):416 (2007)
56. Ran et al. Cell 154(6):1380-1389 (2013)
57. Smith & Waterman Adv Appl Math 2(4):482-489 (1981)
58. Sternberg et al. Nature 507(7490):62-67 (2014)
59. Stone Am J Ophthalmol 144(6):791-811 (2007)
60. Tsai et al. Nat Biotechnol 34(5):483 (2016)
61. Valente et al. Nat Genet 38(6):623-625 (2006)
62. Wang et al. Cell 153(4):910-918 (2013)
63. Xiao et al. Bioinformatics 30(8):1180-1182 (2014)
64. Zetsche et al. Nat Biotechnol 33(2):139-142 (2015)

SEQUENCE LISTING (2801 sequences)

SEQ ID NO: 1 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 2 - protein, 1368 aa, Streptococcus pyogenes [sequence omitted]

SEQ ID NO: 3 - protein, 1388 aa, Streptococcus thermophilus
MTKPYSIGLDIGTNSVGWAVTTDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKKLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTFWYQLLKSKLISQRKFDNLTKAERGGLSPEDKAGFIQRQLVETRQITKHVARLLDEKFNNKKDENNRAVRTVKIITLKSTLVSQFRKDFELYKVREINDFHHAHDAYLNAVVASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFTVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 4 - protein, 1333 aa, Listeria innocua
KKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 5 - RNA, 96 nt, Artificial Sequence
  gRNA
  misc_feature (1)..(20): Targeting domain, each n is a, c, u, g, unknown, or other
nnnnnnnnnnnnnnnnnnnnguuuuagagcuagaaauagcaaguuaaaauaaggcuaguccguuaucaacuugaaaaaguggcaccgagucggugc

SEQ ID NO: 6-7 - skipped (2 entries)

SEQ ID NO: 8 - protein, 12 aa, Artificial Sequence
  N-term RuvC domain
  MISC_FEATURE (2)..(2): Ile, Val, Met, Leu, or Thr
  MISC_FEATURE (4)..(4): Thr, Ile, Val, Ser, Asn, Tyr, Glu, or Leu
  MISC_FEATURE (5)..(5): Asn, Ser, Gly, Ala, Asp, Thr, Arg, Met, or Phe
  MISC_FEATURE (6)..(6): Ser, Tyr, Asn, or Phe
  MISC_FEATURE (7)..(7): Val, Ile, Leu, Cys, Thr, or Phe
  MISC_FEATURE (9)..(9): Trp, Phe, Val, Tyr, Ser, or Leu
  MISC_FEATURE (10)..(10): Ala, Ser, Cys, Val, or Gly
  MISC_FEATURE (11)..(11): Val, Ile, Leu, Ala, Met, or His
  MISC_FEATURE (12)..(12): Any amino acid or absent
DXGXXXXGXXXX

SEQ ID NO: 9 - protein, 12 aa, Artificial Sequence
  N-term RuvC domain
  MISC_FEATURE (2)..(2): Ile, Val, Met, Leu, or Thr
  MISC_FEATURE (4)..(4): Thr, Ile, Val, Ser, Asn, Tyr, Glu, or Leu
  MISC_FEATURE (5)..(5): Asn, Ser, Gly, Ala, Asp, Thr, Arg, Met, or Phe
  MISC_FEATURE (7)..(7): Val, Ile, Leu, Cys, Thr, Phe
  MISC_FEATURE (9)..(9): Trp, Phe, Val, Tyr, Ser, or Leu
  MISC_FEATURE (10)..(10): Ala, Ser, Cys, Val, or Gly
  MISC_FEATURE (11)..(11): Val, Ile, Leu, Ala, Met, or His
  MISC_FEATURE (12)..(12): Any amino acid or absent
DXGXXSXGXXXX

SEQ ID NO: 10 - protein, 12 aa, Artificial Sequence
  N-term RuvC domain
  MISC_FEATURE (4)..(4): Thr, Ile, Val, Ser, Asn, Tyr, Glu, or Leu
  MISC_FEATURE (5)..(5): Asn, Ser, Gly, Ala, Asp, Thr, Arg, Met, or Phe
  MISC_FEATURE (11)..(11): Val, Ile, Leu, Ala, Met, or His
  MISC_FEATURE (12)..(12): Any amino acid or absent
DIGXXSVGWAXX

SEQ ID NO: 11 - protein, 12 aa, Artificial Sequence
  N-term RuvC domain
  MISC_FEATURE (12)..(12): Any non-polar alkyl amino acid or a hydroxyl amino acid
DIGTNSVGWAVX

SEQ ID NO: 12 - protein, 8 aa, Artificial Sequence
  N-term RuvC domain
  MISC_FEATURE (2)..(2): Val or His
  MISC_FEATURE (3)..(3): Ile, Leu, or Val
  MISC_FEATURE (5)..(5): Met or Thr
IXXEXARE

SEQ ID NO: 13 - protein, 8 aa, Artificial Sequence
  RuvC domain
  MISC_FEATURE (3)..(3): Ile, Leu, or Val
IVXEMARE

SEQ ID NO: 14 - protein, 8 aa, Artificial Sequence
  RuvC domain
  MISC_FEATURE (4)..(4): His or Leu
  MISC_FEATURE (7)..(7): Arg or Val
  MISC_FEATURE (8)..(8): Glu or Val
HHAXDAXX

SEQ ID NO: 15 - protein, 8 aa, Artificial Sequence
  RuvC domain
HHAHDAYL

SEQ ID NO: 16 - protein, 30 aa, Artificial Sequence
  Sequence flanking RuvC domain
  MISC_FEATURE (2)..(2): Lys or Pro
  MISC_FEATURE (4)..(4): Val, Leu, Ile, or Phe
  MISC_FEATURE (5)..(5): Gly, Ala, or Ser
  misc_feature (6)..(6): Xaa can be any naturally occurring amino acid
  MISC_FEATURE (7)..(26): Any amino acid, and region may encompass 5-20 residues wherein some positions may be absent
  MISC_FEATURE (29)..(29): Asp, Glu, Asn, or Gln
KXYXXXXXXXXXXXXXXXXXXXXXXXTDXY

SEQ ID NO: 17 - protein, 27 aa, Artificial Sequence
  HNH-like domain
  MISC_FEATURE (1)..(1): Asp, Glu, Gln, or Asn
  MISC_FEATURE (2)..(2): Leu, Ile, Arg, Gln, Val, Met, or Lys
  MISC_FEATURE (3)..(3): Asp or Glu
  MISC_FEATURE (5)..(5): Ile, Val, Thr, Ala, or Leu
  MISC_FEATURE (6)..(6): Val, Tyr, Ile, Leu, Phe, or Trp
  MISC_FEATURE (8)..(8): Gln, His, Arg, Lys, Tyr, Ile, Leu, Phe, or Trp
  MISC_FEATURE (9)..(9): Ser, Ala, Asp, Thr, or Lys
  MISC_FEATURE (10)..(10): Phe, Leu, Val, Lys, Tyr, Met, Ile, Arg, Ala, Glu, Asp, or Gln
  MISC_FEATURE (11)..(11): Leu, Arg, Thr, Ile, Val, Ser, Cys, Tyr, Lys, Phe, or Gly
  MISC_FEATURE (12)..(12): Lys, Gln, Tyr, Thr, Phe, Leu, Trp, Met, Ala, Glu, Gly, or Ser
  MISC_FEATURE (13)..(13): Asp, Ser, Asn, Arg, Leu, or Thr
  MISC_FEATURE (14)..(14): Asp, Asn, or Ser
  MISC_FEATURE (15)..(15): Ser, Ala, Thr, Gly, or Arg
  MISC_FEATURE (16)..(16): Ile, Leu, Phe, Ser, Arg, Tyr, Gln, Trp, Asp, Lys, or His
  MISC_FEATURE (17)..(17): Asp, Ser, Ile, Asn, Glu, Ala, His, Phe, Leu, Gln, Met, Gly, Tyr, or Val
  MISC_FEATURE (19)..(19): Lys, Leu, Arg, Met, Thr, or Phe
  MISC_FEATURE (20)..(20): Val, Leu, Ile, Ala, or Thr
  MISC_FEATURE (21)..(21): Leu, Ile, Val, or Ala
  MISC_FEATURE (22)..(22): Thr, Val, Cys, Glu, Ser, or Ala
  MISC_FEATURE (23)..(23): Arg, Phe, Thr, Trp, Glu, Leu, Asn, Cys, Lys, Val, Ser, Gln, Ile, Tyr, His, or Ala
  MISC_FEATURE (24)..(24): Ser, Pro, Arg, Lys, Asn, Ala, His, Gln, Gly, or Leu
  MISC_FEATURE (25)..(25): Asp, Gly, Thr, Asn, Ser, Lys, Ala, Ile, Glu, Leu, Gln, Arg, or Tyr
  MISC_FEATURE (26)..(26): Lys, Val, Ala, Glu, Tyr, Ile, Cys, Leu, Ser, Thr, Gly, Lys, Met, Asp, or Phe
XXXHXXPXXXXXXXXXXNXXXXXXXXN

SEQ ID NO: 18 - protein, 27 aa, Artificial Sequence
  HNH-like domain
  MISC_FEATURE (1)..(1): Asp or Glu
  MISC_FEATURE (2)..(2): Leu, Ile, Arg, Gln, Val, Met, or Lys
  MISC_FEATURE (3)..(3): Asp or Glu
  MISC_FEATURE (5)..(5): Ile, Val, Thr, Ala, or Leu
  MISC_FEATURE (6)..(6): Val, Tyr, Ile, Leu, Phe, or Trp
  MISC_FEATURE (8)..(8): Gln, His, Arg, Lys, Tyr, Ile, Leu, Phe, or Trp
  MISC_FEATURE (10)..(10): Phe, Leu, Val, Lys, Tyr, Met, Ile, Arg, Ala, Glu, Asp, or Gln
  MISC_FEATURE (11)..(11): Leu, Arg, Thr, Ile, Val, Ser, Cys, Tyr, Lys, Phe, or Gly
  MISC_FEATURE (12)..(12): Lys, Gln, Tyr, Thr, Phe, Leu, Trp, Met, Ala, Glu, Gly, or Ser
  MISC_FEATURE (16)..(16): Ile, Leu, Phe, Ser, Arg, Tyr, Gln, Trp, Asp, Lys, or His
  MISC_FEATURE (17)..(17): Asp, Ser, Ile, Asn, Glu, Ala, His, Phe, Leu, Gln, Met, Gly, Tyr, or Val
  MISC_FEATURE (22)..(22): Thr, Val, Cys, Glu, Ser, or Ala
  MISC_FEATURE (23)..(23): Arg, Phe, Thr, Trp, Glu, Leu, Asn, Cys, Lys, Val, Ser, Gln, Ile, Tyr, His, or Ala
  MISC_FEATURE (24)..(24): Ser, Pro, Arg, Lys, Asn, Ala, His, Gln, Gly, or Leu
  MISC_FEATURE (25)..(25): Asp, Gly, Thr, Asn, Ser, Lys, Ala, Ile, Glu, Leu, Gln, Arg, or Tyr
  MISC_FEATURE (26)..(26): Lys, Val, Ala, Glu, Tyr, Ile, Cys, Leu, Ser, Thr, Gly, Lys, Met, Asp, or Phe
XXXHXXPXSXXXDDSXXNKVLXXXXXN

SEQ ID NO: 19 - protein, 27 aa, Artificial Sequence
  HNH-like domain
  MISC_FEATURE (1)..(1): Asp or Glu
  MISC_FEATURE (3)..(3): Asp or Glu
  MISC_FEATURE (8)..(8): Gln, His, Arg, Lys, Tyr, Ile, Leu, or Trp
  MISC_FEATURE (10)..(10): Phe, Leu, Val, Lys, Tyr, Met, Ile, Arg, Ala, Glu, Asp, or Gln
  MISC_FEATURE (11)..(11): Leu, Arg, Thr, Ile, Val, Ser, Cys, Tyr, Lys, Phe, or Gly
  MISC_FEATURE (12)..(12): Lys, Gln, Tyr, Thr, Phe, Leu, Trp, Met, Ala, Glu, Gly, or Ser
  MISC_FEATURE (16)..(16): Ile, Leu, Phe, Ser, Arg, Tyr, Gln, Trp, Asp, Lys, or His
  MISC_FEATURE (17)..(17): Asp, Ser, Ile, Asn, Glu, Ala, His, Phe, Leu, Gln, Met, Gly, Tyr, or Val
  MISC_FEATURE (23)..(23): Arg, Phe, Thr, Trp, Glu, Leu, Asn, Cys, Lys, Val, Ser, Gln, Ile, Tyr, His, or Ala
  MISC_FEATURE (24)..(24): Ser, Pro, Arg, Lys, Asn, Ala, His, Gln, Gly, or Leu
  MISC_FEATURE (25)..(25): Asp, Gly, Thr, Asn, Ser, Lys, Ala, Ile, Glu, Leu, Gln, Arg, or Tyr
  MISC_FEATURE (26)..(26): Lys, Val, Ala, Glu, Tyr, Ile, Cys, Leu, Ser, Thr, Gly, Lys, Met, Asp, or Phe
XVXHIVPXSXXXDDSXXNKVLTXXXXN

SEQ ID NO: 20 - protein, 27 aa, Artificial Sequence
  HNH-like domain
  MISC_FEATURE (2)..(2): Ile or Val
  MISC_FEATURE (6)..(6): Ile or Val
  MISC_FEATURE (9)..(9): Ala or Ser
  MISC_FEATURE (11)..(11): Ile or Leu
  MISC_FEATURE (12)..(12): Lys or Thr
  MISC_FEATURE (14)..(14): Asp or Asn
  MISC_FEATURE (19)..(19): Arg, Lys, or Leu
  MISC_FEATURE (22)..(22): Thr or Val
  MISC_FEATURE (23)..(23): Ser or Arg
  MISC_FEATURE (25)..(25): Lys, Asp, or Ala
  MISC_FEATURE (26)..(26): Glu, Lys, Gly, or Asn
DXDHIXPQXFXXDXSIDNXVLXXSXXN

SEQ ID NO: 21 - protein, 73 aa, Artificial Sequence
  Synthetic polypeptide
  MISC_FEATURE (8)..(8): Lys or Arg
  MISC_FEATURE (12)..(12): Val or Thr
  MISC_FEATURE (13)..(13): Gly or Asp
  MISC_FEATURE (14)..(14): Glu, Gln, or Asp
  MISC_FEATURE (15)..(15): Glu or Asp
  MISC_FEATURE (19)..(19): Asp, Asn, or His
  MISC_FEATURE (20)..(20): Tyr, Arg, or Asn
  MISC_FEATURE (23)..(23): Gln, Asp, or Asn
  MISC_FEATURE (25)..(64): Any amino acid, and region may encompass 15-40 residues wherein some positions may be absent
  MISC_FEATURE (67)..(67): Gly or Glu
  MISC_FEATURE (69)..(69): Ser or Gly
  MISC_FEATURE (71)..(71): Asp or Asn
LYYLQNGXDMYXXXXLDIXXLSXYXXXXXXXXXXXXXXXXXXXXXXXXXXXXXXXXXXXXXXXXNRXKXDXVP

SEQ ID NO: 22 - DNA, 4107 bp, Artificial Sequence
  Codon optimized S. pyogenes Cas9
atggataaaaagtacagcatcgggctggacatcggtacaaactcagtggggtgggccgtgattacggacgagtacaaggtaccctccaaaaaatttaaagtgctgggtaacacggacagacactctataaagaaaaatcttattggagccttgctgttcgactcaggcgagacagccgaagccacaaggttgaagcggaccgccaggaggcggtataccaggagaaagaaccgcatatgctacctgcaagaaatcttcagtaacgagatggcaaaggttgacgatagctttttccatcgcctggaagaatcctttcttgttgaggaagacaagaagcacgaacggcaccccatctttggcaatattgtcgacgaagtggcatatcacgaaaagtacccgactatctaccacctcaggaagaagctggtggactctaccgataaggcggacctcagacttatttatttggcactcgcccacatgattaaatttagaggacatttcttgatcgagggcgacctgaacccggacaacagtgacgtcgataagctgttcatccaacttgtgcagacctacaatcaactgttcgaagaaaaccctataaatgcttcaggagtcgacgctaaagcaatcctgtccgcgcgcctctcaaaatctagaagacttgagaatctgattgctcagttgcccggggaaaagaaaaatggattgtttggcaacctgatcgccctcagtctcggactgaccccaaatttcaaaagtaacttcgacctggccgaagacgctaagctccagctgtccaaggacacatacgatgacgacctcgacaatctgctggcccagattggggatcagtacgccgatctctttttggcagcaaagaacctgtccgacgccatcctgttgagcgatatcttgagagtgaacaccgaaattactaaagcaccccttagcgcatctatgatcaagcggtacgacgagcatcatcaggatctgaccctgctgaaggctcttgtgaggcaacagctccccgaaaaatacaaggaaatcttctttgaccagagcaaaaacggctacgctggctatatagatggtggggccagtcaggaggaattctataaattcatcaagcccattctcgagaaaatggacggcacagaggagttgctggtcaaacttaacagggaggacctgctgcggaagcagcggacctttgacaacgggtctatcccccaccagattcatctgggcgaactgcacgcaatcctgaggaggcaggaggatttttatccttttcttaaagataaccgcgagaaaatagaaaagattcttacattcaggatcccgtactacgtgggacctctcgcccggggcaattcacggtttgcctggatgacaaggaagtcagaggagactattacaccttggaacttcgaagaagtggtggacaagggtgcatctgcccagtctttcatcgagcggatgacaaattttgacaagaacctccctaatgagaaggtgctgcccaaacattctctgctctacgagtactttaccgtctacaatgaactgactaaagtcaagtacgtcaccgagggaatgaggaagccggcattccttagtggagaacagaagaaggcgattgtagacctgttgttcaagaccaacaggaaggtgactgtgaagcaacttaaagaagactactttaagaagatcgaatgttttgacagtgtggaaatttcaggggttgaagaccgcttcaatgcgtcattggggacttaccatgatcttctcaagatcataaaggacaaagacttcctggacaacgaagaaaatgaggatattctcgaagacatcgtcctcaccctgaccctgttcgaagacagggaaatgatagaagagcgcttgaaaacctatgcccacctcttcgacgataaagttatgaagcagctgaagcgcaggagatacacaggatggggaagattgtcaaggaagctgatcaatggaattagggataaacagagtggcaagaccatactggatttcctcaaatctgatggcttcgccaataggaacttcatgcaactgattcacgatgactctcttaccttcaaggaggacattcaaaaggctcaggtgagcgggcagggagactcccttcatgaacacatcgcgaatttggcaggttcccccgctattaaaaagggcatccttcaaactgtcaaggtggtggatgaattggtcaaggtaatgggcagacataagccagaaaatattgtgatcgagatggcccgcgaaaaccagaccacacagaagggccagaaaaatagtagagagcggatgaagaggatcgaggagggcatcaaagagctgggatctcagattctcaaagaacaccccgtagaaaacacacagctgcagaacgaaaaattgtacttgtactatctgcagaacggcagagacatgtacgtcgaccaagaacttgatattaatagactgtccgactatgacgtagaccatatcgtgccccagtccttcctgaaggacgactccattgataacaaagtcttgacaagaagcgacaagaacaggggtaaaagtgataatgtgcctagcgaggaggtggtgaaaaaaatgaagaactactggcgacagctgcttaatgcaaagctcattacacaacggaagttcgataatctgacgaaagcagagagaggtggcttgtctgagttggacaaggcagggtttattaagcggcagctggtggaaactaggcagatcacaaagcacgtggcgcagattttggacagccggatgaacacaaaatacgacgaaaatgataaactgatacgagaggtcaaagttatcacgctgaaaagcaagctggtgtccgattttcggaaagacttccagttctacaaagttcgcgagattaataactaccatcatgctcacgatgcgtacctgaacgctgttgtcgggaccgccttgataaagaagtacccaaagctggaatccgagttcgtatacggggattacaaagtgtacgatgtgaggaaaatgatagccaagtccgagcaggagattggaaaggccacagctaagtacttcttttattctaacatcatgaatttttttaagacggaaattaccctggccaacggagagatcagaaagcggccccttatagagacaaatggtgaaacaggtgaaatcgtctgggataagggcagggatttcgctactgtgaggaaggtgctgagtatgccacaggtaaatatcgtgaaaaaaaccgaagtacagaccggaggattttccaaggaaagcattttgcctaaaagaaactcagacaagctcatcgcccgcaagaaagattgggaccctaagaaatacgggggatttgactcacccaccgtagcctattctgtgctggtggtagctaaggtggaaaaaggaaagtctaagaagctgaagtccgtgaaggaactcttgggaatcactatcatggaaagatcatcctttgaaaagaaccctatcgatttcctggaggctaagggttacaaggaggtcaagaaagacctcatcattaaactgccaaaatactctctcttcgagctggaaaatggcaggaagagaatgttggccagcgccggagagctgcaaaagggaaacgagcttgctctgccctccaaatatgttaattttctctatctcgcttcccactatgaaaagctgaaagggtctcccgaagataacgagcagaagcagctgttcgtcgaacagcacaagcactatctggatgaaataatcgaacaaataagcgagttcagcaaaagggttatcctggcggatgctaatttggacaaagtactgtctgcttataacaagcaccgggataagcctattagggaacaagccgagaatataattcacctctttacactcacgaatctcggagcccccgccgccttcaaatactttgatacgactatcgaccggaaacggtataccagtaccaaagaggtcctcgatgccaccctcatccaccagtcaattactggcctgtacgaaacacggatcgacctctctcaactgggcggcgactag

SEQ ID NO: 23 - skipped

SEQ ID NO: 24 - DNA, 3249 bp, Artificial Sequence
  Codon optimized N. meningitidis Cas9
atggccgccttcaagcccaaccccatcaactacatcctgggcctggacatcggcatcgccagcgtgggctgggccatggtggagatcgacgaggacgagaaccccatctgcctgatcgacctgggtgtgcgcgtgttcgagcgcgctgaggtgcccaagactggtgacagtctggctatggctcgccggcttgctcgctctgttcggcgccttactcgccggcgcgctcaccgccttctgcgcgctcgccgcctgctgaagcgcgagggtgtgctgcaggctgccgacttcgacgagaacggcctgatcaagagcctgcccaacactccttggcagctgcgcgctgccgctctggaccgcaagctgactcctctggagtggagcgccgtgctgctgcacctgatcaagcaccgcggctacctgagccagcgcaagaacgagggcgagaccgccgacaaggagctgggtgctctgctgaagggcgtggccgacaacgcccacgccctgcagactggtgacttccgcactcctgctgagctggccctgaacaagttcgagaaggagagcggccacatccgcaaccagcgcggcgactacagccacaccttcagccgcaaggacctgcaggccgagctgatcctgctgttcgagaagcagaaggagttcggcaacccccacgtgagcggcggcctgaaggagggcatcgagaccctgctgatgacccagcgccccgccctgagcggcgacgccgtgcagaagatgctgggccactgcaccttcgagccagccgagcccaaggccgccaagaacacctacaccgccgagcgcttcatctggctgaccaagctgaacaacctgcgcatcctggagcagggcagcgagcgccccctgaccgacaccgagcgcgccaccctgatggacgagccctaccgcaagagcaagctgacctacgcccaggcccgcaagctgctgggtctggaggacaccgccttcttcaagggcctgcgctacggcaaggacaacgccgaggccagcaccctgatggagatgaaggcctaccacgccatcagccgcgccctggagaaggagggcctgaaggacaagaagagtcctctgaacctgagccccgagctgcaggacgagatcggcaccgccttcagcctgttcaagaccgacgaggacatcaccggccgcctgaaggaccgcatccagcccgagatcctggaggccctgctgaagcacatcagcttcgacaagttcgtgcagatcagcctgaaggccctgcgccgcatcgtgcccctgatggagcagggcaagcgctacgacgaggcctgcgccgagatctacggcgaccactacggcaagaagaacaccgaggagaagatctacctgcctcctatccccgccgacgagatccgcaaccccgtggtgctgcgcgccctgagccaggcccgcaaggtgatcaacggcgtggtgcgccgctacggcagccccgcccgcatccacatcgagaccgcccgcgaggtgggcaagagcttcaaggaccgcaaggagatcgagaagcgccaggaggagaaccgcaaggaccgcgagaaggccgccgccaagttccgcgagtacttccccaacttcgtgggcgagcccaagagcaaggacatcctgaagctgcgcctgtacgagcagcagcacggcaagtgcctgtacagcggcaaggagatcaacctgggccgcctgaacgagaagggctacgtggagatcgaccacgccctgcccttcagccgcacctgggacgacagcttcaacaacaaggtgctggtgctgggcagcgagaaccagaacaagggcaaccagaccccctacgagtacttcaacggcaaggacaacagccgcgagtggcaggagttcaaggcccgcgtggagaccagccgcttcccccgcagcaagaagcagcgcatcctgctgcagaagttcgacgaggacggcttcaaggagcgcaacctgaacgacacccgctacgtgaaccgcttcctgtgccagttcgtggccgaccgcatgcgcctgaccggcaagggcaagaagcgcgtgttcgccagcaacggccagatcaccaacctgctgcgcggcttctggggcctgcgcaaggtgcgcgccgagaacgaccgccaccacgccctggacgccgtggtggtggcctgcagcaccgtggccatgcagcagaagatcacccgcttcgtgcgctacaaggagatgaacgccttcgacggtaaaaccatcgacaaggagaccggcgaggtgctgcaccagaagacccacttcccccagccctgggagttcttcgcccaggaggtgatgatccgcgtgttcggcaagcccgacggcaagcccgagttcgaggaggccgacacccccgagaagctgcgcaccctgctggccgagaagctgagcagccgccctgaggccgtgcacgagtacgtgactcctctgttcgtgagccgcgcccccaaccgcaagatgagcggtcagggtcacatggagaccgtgaagagcgccaagcgcctggacgagggcgtgagcgtgctgcgcgtgcccctgacccagctgaagctgaaggacctggagaagatggtgaaccgcgagcgcgagcccaagctgtacgaggccctgaaggcccgcctggaggcccacaaggacgaccccgccaaggccttcgccgagcccttctacaagtacgacaaggccggcaaccgcacccagcaggtgaaggccgtgcgcgtggagcaggtgcagaagaccggcgtgtgggtgcgcaaccacaacggcatcgccgacaacgccaccatggtgcgcgtggacgtgttcgagaagggcgacaagtactacctggtgcccatctacagctggcaggtggccaagggcatcctgcccgaccgcgccgtggtgcagggcaaggacgaggaggactggcagctgatcgacgacagcttcaacttcaagttcagcctgcaccccaacgacctggtggaggtgatcaccaagaaggcccgcatgttcggctacttcgccagctgccaccgcggcaccggcaacatcaacatccgcatccacgacctggaccacaagatcggcaagaacggcatcctggagggcatcggcgtgaagaccgccctgagcttccagaagtaccagatcgacgagctgggcaaggagatccgcccctgccgcctgaagaagcgccctcctgtgcgctaa

SEQ ID NO: 25 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 26 - protein, 1053 aa, Staphylococcus aureus
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 27 - RNA, 104 nt, Artificial Sequence
  gRNA
  misc_feature (1)..(20): Targeting domain, each n is a, c, u, g, unknown, or other
nnnnnnnnnnnnnnnnnnnnguuuuagagcuaugcugaaaagcauagcaaguuaaaauaaggcuaguccguuaucaacuugaaaaaguggcaccgagucggugc

SEQ ID NO: 28 - RNA, 106 nt, Artificial Sequence
  gRNA
  misc_feature (1)..(20): Targeting domain, each n is a, c, u, g, unknown, or other
nnnnnnnnnnnnnnnnnnnnguuuuagagcuaugcuggaaacagcauagcaaguuaaaauaaggcuaguccguuaucaacuugaaaaaguggcaccgagucggugc

SEQ ID NO: 29 - RNA, 116 nt, Artificial Sequence
  gRNA
  misc_feature (1)..(20): Targeting domain, each n is a, c, u, g, unknown, or other
nnnnnnnnnnnnnnnnnnnnguuuuagagcuaugcuguuuuggaaacaaaacagcauagcaaguuaaaauaaggcuaguccguuaucaacuugaaaaaguggcaccgagucggugc

SEQ ID NO: 30 - RNA, 96 nt, Artificial Sequence
  gRNA
  misc_feature (1)..(20): Targeting domain, each n is a, c, u, g, unknown, or other
nnnnnnnnnnnnnnnnnnnnguauuagagcuagaaauagcaaguuaauauaaggcuaguccguuaucaacuugaaaaaguggcaccgagucggugc

SEQ ID NO: 31 - RNA, 96 nt, Artificial Sequence
  gRNA
  misc_feature (1)..(20): Targeting domain, each n is a, c, u, g, unknown, or other
nnnnnnnnnnnnnnnnnnnnguuuaagagcuagaaauagcaaguuuaaauaaggcuaguccguuaucaacuugaaaaaguggcaccgagucggugc

SEQ ID NO: 32 - RNA, 116 nt, Artificial Sequence
  gRNA
  misc_feature (1)..(20): Targeting domain, each n is a, c, u, g, unknown, or other
nnnnnnnnnnnnnnnnnnnnguauuagagcuaugcuguauuggaaacaauacagcauagcaaguuaauauaaggcuaguccguuaucaacuugaaaaaguggcaccgagucggugc

SEQ ID NO: 33 - RNA, 47 nt, Artificial Sequence
  Proximal and tail domains
aaggcuaguccguuaucaacuugaaaaaguggcaccgagucggugcu

SEQ ID NO: 34 - RNA, 49 nt, Artificial Sequence
  Proximal and tail domains
aaggcuaguccguuaucaacuugaaaaaguggcaccgagucgguggugc

SEQ ID NO: 35 - RNA, 51 nt, Artificial Sequence
  Proximal and tail domains
aaggcuaguccguuaucaacuugaaaaaguggcaccgagucggugcggauc

SEQ ID NO: 36 - RNA, 31 nt, Artificial Sequence
  Proximal and tail domains
aaggcuaguccguuaucaacuugaaaaagug

SEQ ID NO: 37 - RNA, 18 nt, Artificial Sequence
  Proximal and tail domains
aaggcuaguccguuauca

SEQ ID NO: 38 - RNA, 12 nt, Artificial Sequence
  Proximal and tail domains
aaggcuaguccg

SEQ ID NO: 39 - DNA, 3159 bp, Artificial Sequence
  Codon optimized S. aureus Cas9
atgaaaaggaactacattctggggctggacatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagagaactctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggc

SEQ ID NO: 40-41 - skipped (2 entries)

SEQ ID NO: 42 - RNA, 42 nt, Artificial Sequence
  S. pyogenes gRNA, targeting and first complementarity domains
  misc_feature (1)..(20): Targeting domain, each n is a, c, u, g, unknown, or other
  misc_feature (21)..(42): First complementarity domain
nnnnnnnnnnnnnnnnnnnnguuuuagagcuaugcuguuuug

SEQ ID NO: 43 - RNA, 85 nt, Artificial Sequence
  S. pyogenes gRNA, 5' extension, 2nd complementarity, proximal, and tail domains
  misc_feature (1)..(9): 5' extension domain
  misc_feature (10)..(33): Second complementarity domain
  misc_feature (34)..(45): Proximal domain
  misc_feature (46)..(85): Tail domain
ggaaccauucaaaacagcauagcaaguuaaaauaaggcuaguccguuaucaacuugaaaaaguggcaccgagucggugcuuuuuu

SEQ ID NO: 44 - RNA, 62 nt, Artificial Sequence
  S. pyogenes gRNA
  misc_feature (1)..(20): Targeting domain, each n is a, c, u, g, unknown, or other
  misc_feature (21)..(32): First complementarity domain
  misc_feature (33)..(36): Linking domain
  misc_feature (37)..(50): Second complementarity domain
  misc_feature (51)..(62): Proximal domain
nnnnnnnnnnnnnnnnnnnnguuuuagagcuagaaauagcaaguuaaaauaaggcuaguccg

SEQ ID NO: 45 - RNA, 102 nt, Artificial Sequence
  S. pyogenes gRNA
  misc_feature (1)..(20): Targeting domain, each n is a, c, u, g, unknown, or other
  misc_feature (21)..(32): First complementarity domain
  misc_feature (33)..(36): Linking domain
  misc_feature (37)..(50): Second complementarity domain
  misc_feature (51)..(62): Proximal domain
  misc_feature (63)..(102): Tail domain
nnnnnnnnnnnnnnnnnnnnguuuuagagcuagaaauagcaaguuaaaauaaggcuaguccguuaucaacuugaaaaaguggcaccgagucggugcuuuuuu

SEQ ID NO: 46 - RNA, 75 nt, Artificial Sequence
  S. pyogenes gRNA
  misc_feature (1)..(20): Targeting domain, each n is a, c, u, g, unknown, or other
  misc_feature (21)..(36): First complementarity domain
  misc_feature (37)..(40): Linking domain
  misc_feature (41)..(58): Second complementarity domain
  misc_feature (59)..(70): Proximal domain
  misc_feature (71)..(75): Tail domain
nnnnnnnnnnnnnnnnnnnnguuuuagagcuaugcugaaaagcauagcaaguuaaaauaaggcuaguccguuauc

SEQ ID NO: 47 - RNA, 87 nt, Artificial Sequence
  S. pyogenes gRNA
  misc_feature (1)..(20): Targeting domain, each n is a, c, u, g, unknown, or other
  misc_feature (21)..(32): First complementarity domain
  misc_feature (57)..(70): Second complementarity domain
  misc_feature (71)..(82): Proximal domain
  misc_feature (83)..(87): Tail domain
nnnnnnnnnnnnnnnnnnnnguuuuagagcuaugcuguuuuggaaacaaaacagcauagcaaguuaaaauaaggcuaguccguuauc

SEQ ID NO: 48 - RNA, 42 nt, Artificial Sequence
  S. thermophilus gRNA, targeting and first complementarity domains
  misc_feature (1)..(20): Targeting domain, each n is a, c, u, g, unknown, or other
  misc_feature (21)..(42): First complementarity domain
nnnnnnnnnnnnnnnnnnnnguuuuagagcuguguuguuucg

SEQ ID NO: 49 - RNA, 78 nt, Artificial Sequence
  S. thermophilus gRNA, 5' extension, second complementarity, proximal, and tail domains
  misc_feature (1)..(3): 5' extension domain
  misc_feature (4)..(27): Second complementarity domain
  misc_feature (28)..(40): Proximal domain
  misc_feature (41)..(78): Tail domain
gggcgaaacaacacagcgaguuaaaauaaggcuuaguccguacucaacuugaaaagguggcaccgauucgguguuuuu

SEQ ID NO: 50-51 - skipped (2 entries)

SEQ ID NO: 52 - RNA, 85 nt, Streptococcus pyogenes
gaaccauucaaaacagcauagcaaguuaaaauaaggcuaguccguuaucaacuugaaaaaguggcaccgagucggugcuuuuuuu

SEQ ID NO: 53 - skipped

SEQ ID NO: 54 - protein, 12 aa, Artificial Sequence
  N terminal RuvC-like domain
DIGTNSVGWAVT

SEQ ID NO: 55 - skipped

SEQ ID NO: 56 - protein, 12 aa, Artificial Sequence
  N terminal RuvC-like domain
DVGTNSVGWAVT

SEQ ID NO: 57 - skipped

SEQ ID NO: 58 - protein, 12 aa, Artificial Sequence
  N terminal RuvC-like domain
DMGTNSVGWAVT

SEQ ID NO: 59 - protein, 12 aa, Artificial Sequence
  N terminal RuvC-like domain
DVGTSSVGWAVT

SEQ ID NO: 60 - protein, 12 aa, Artificial Sequence
  N terminal RuvC-like domain
DIGTASVGWAVT

SEQ ID NO: 61 - protein, 12 aa, Artificial Sequence
  N terminal RuvC-like domain
DVGTGSVGWAVT

SEQ ID NO: 62 - protein, 12 aa, Artificial Sequence
  N terminal RuvC-like domain
DIGTNSVGWAVV

SEQ ID NO: 63 - protein, 12 aa, Artificial Sequence
  N terminal RuvC-like domain
DIGTNSVGWAVI

SEQ ID NO: 64 - protein, 12 aa, Artificial Sequence
  N terminal RuvC-like domain
DIGTNSVGWAVL

SEQ ID NO: 65 - protein, 12 aa, Artificial Sequence
  N terminal RuvC-like domain
DLGTNSIGWAVV

SEQ ID NO: 66 - protein, 11 aa, Artificial Sequence
  N terminal RuvC-like domain
DLGTNSIGWAI

SEQ ID NO: 67 - protein, 12 aa, Artificial Sequence
  N terminal RuvC like domain
DLGTNSIGWALV

SEQ ID NO: 68 - protein, 12 aa, Artificial Sequence
  N terminal RuvC-like domain
DIGTNSVGWCVT

SEQ ID NO: 69 - protein, 12 aa, Artificial Sequence
  N terminal RuvC-like domain
DIGTNSVGYAVT

SEQ ID NO: 70 - protein, 12 aa, Artificial Sequence
  N terminal RuvC-like domain
DMGTGSLGWAVT

SEQ ID NO: 71 - protein, 12 aa, Artificial Sequence
  N terminal RuvC-like domain
DIGTSSVGWAAI

SEQ ID NO: 72 - protein, 12 aa, Artificial Sequence
  N terminal RuvC-like domain
DLGTGSVGWAVV

SEQ ID NO: 73 - protein, 12 aa, Artificial Sequence
  N terminal RuvC-like domain
DLGVGSVGWAIV

SEQ ID NO: 74 - protein, 12 aa, Artificial Sequence
  N terminal RuvC-like domain
DLGIASIGWAII

SEQ ID NO: 75 - protein, 12 aa, Artificial Sequence
  N terminal RuvC-like domain
DLGIASVGWAIV

SEQ ID NO: 76 - protein, 12 aa, Artificial Sequence
  N terminal RuvC-like domain
DLGVASVGWSIV

SEQ ID NO: 77 - protein, 12 aa, Artificial Sequence
  N terminal RuvC-like domain
DIGIASVGWAIL

SEQ ID NO: 78 - protein, 12 aa, Artificial Sequence
  N terminal RuvC-like domain
DLGISSVGWSVI

SEQ ID NO: 79 - protein, 12 aa, Artificial Sequence
  N terminal RuvC-like domain
DIGIASVGWSVI

SEQ ID NO: 80 - protein, 12 aa, Artificial Sequence
  N terminal RuvC-like domain
DVGIGSIGWAVI

SEQ ID NO: 81 - protein, 12 aa, Artificial Sequence
  N terminal RuvC-like domain
DLGVGSIGFAIV

SEQ ID NO: 82 - protein, 12 aa, Artificial Sequence
  N terminal RuvC-like domain
DIGYASIGWAVI

SEQ ID NO: 83 - protein, 12 aa, Artificial Sequence
  N terminal RuvC-like domain
DTGTNSLGWAIV

SEQ ID NO: 84 - protein, 12 aa, Artificial Sequence
  N terminal RuvC-like domain
DLGTNSIGWCLL

SEQ ID NO: 85 - protein, 12 aa, Artificial Sequence
  N terminal RuvC-like domain
DIGTDSLGWAVF

SEQ ID NO: 86 - protein, 12 aa, Artificial Sequence
  N terminal RuvC-like domain
DIGSNSIGFAVV

SEQ ID NO: 87 - protein, 12 aa, Artificial Sequence
  N terminal RuvC-like domain
DLGVGSIGVAVA

SEQ ID NO: 88 - protein, 12 aa, Artificial Sequence
  N terminal RuvC-like domain
DLGIASCGWGVV

SEQ ID NO: 89 - protein, 12 aa, Artificial Sequence
  N terminal RuvC-like domain
DLGIASVGWCLT

SEQ ID NO: 90 - protein, 12 aa, Artificial Sequence
  N terminal RuvC-like domain
DIGIGSVGVGIL

SEQ ID NO: 91 - protein, 12 aa, Artificial Sequence
  N terminal RuvC-like domain
DIGITSVGYGLI

SEQ ID NO: 92 - protein, 12 aa, Artificial Sequence
  N terminal RuvC-like domain
DIGITSVGFGII

SEQ ID NO: 93 - protein, 12 aa, Artificial Sequence
  N terminal RuvC-like domain
DVGITSTGYAVL

SEQ ID NO: 94 - protein, 12 aa, Artificial Sequence
  N terminal RuvC-like domain
DLGITSFGYAIL

SEQ ID NO: 95 - protein, 12 aa, Artificial Sequence
  N terminal RuvC-like domain
DIGNASVGWSAF

SEQ ID NO: 96 - protein, 12 aa, Artificial Sequence
  N terminal RuvC-like domain
DVGTNSCGWVAM

SEQ ID NO: 97 - protein, 12 aa, Artificial Sequence
  N terminal RuvC-like domain
DVGERSIGLAAV

SEQ ID NO: 98 - protein, 12 aa, Artificial Sequence
  N terminal RuvC-like domain
DVGLNSVGLAAV

SEQ ID NO: 99 - protein, 12 aa, Artificial Sequence
  N terminal RuvC-like domain
DVGLMSVGLAAI

SEQ ID NO: 100 - protein, 12 aa, Artificial Sequence
  N terminal RuvC-like domain
DVGTFSVGLAAI

SEQ ID NO: 101 - protein, 12 aa, Artificial Sequence
  N terminal RuvC-like domain
DIGTGSVGYACM

SEQ ID NO: 102 - protein, 12 aa, Artificial Sequence
  N terminal RuvC-like domain
DLGTTSIGFAHI

SEQ ID NO: 103 - protein, 12 aa, Artificial Sequence
  N terminal RuvC-like domain
DLGTNSIGSSVR

SEQ ID NO: 104-113 - skipped (10 entries)

SEQ ID NO: 114 - protein, 12 aa, Artificial Sequence
  N terminal RuvC-like domain
DIGTNSIGWAVI

SEQ ID NO: 115-126 - skipped (12 entries)

SEQ ID NO: 127 - protein, 12 aa, Artificial Sequence
  N terminal RuvC-like domain
DLGIASVGWAVV

SEQ ID NO: 128-129 - skipped (2 entries)

SEQ ID NO: 130 - protein, 12 aa, Artificial Sequence
  N terminal RuvC-like domain
DIGIASVGWAVL

SEQ ID NO: 131 - protein, 12 aa, Artificial Sequence
  N terminal RuvC-like domain
DIGIASIGWAVI

SEQ ID NO: 132 - protein, 12 aa, Artificial Sequence
  N terminal RuvC-like domain
DIGIASVGWAII

SEQ ID NO: 133 - protein, 12 aa, Artificial Sequence
  N terminal RuvC-like domain
DVGIASVGWAVI

SEQ ID NO: 134 - protein, 11 aa, Artificial Sequence
  N terminal RuvC-like domain
DIGIASVGWAL

SEQ ID NO: 135 - protein, 12 aa, Artificial Sequence
  N terminal RuvC-like domain
DIGIASVGWAMV

SEQ ID NO: 136-137 - skipped (2 entries)

SEQ ID NO: 138 - protein, 12 aa, Artificial Sequence
  N terminal RuvC-like domain
DIGITSVGWAVI

SEQ ID NO: 139 - skipped

SEQ ID NO: 140 - protein, 12 aa, Artificial Sequence
  N terminal RuvC-like domain
DLGISSLGWAIV

SEQ ID NO: 141-143 - skipped (3 entries)

SEQ ID NO: 144 - protein, 12 aa, Artificial Sequence
  N terminal RuvC-like domain
DLGTNSIGWGLL

SEQ ID NO: 145-146 - skipped (2 entries)

SEQ ID NO: 147 - protein, 12 aa, Artificial Sequence
  N terminal RuvC-like domain
DLGSTSLGWAIF

SEQ ID NO: 148 - protein, 12 aa, Artificial Sequence
  N terminal RuvC-like domain
DIGISSIGWAFS

SEQ ID NO: 149-151 - skipped (3 entries)

SEQ ID NO: 152 - protein, 12 aa, Artificial Sequence
  N terminal RuvC-like domain
DIGTTSIGFSVI

SEQ ID NO: 153-159 - skipped (7 entries)

SEQ ID NO: 160 - protein, 12 aa, Artificial Sequence
  N terminal RuvC-like domain
DIGTSSIGWWLY

SEQ ID NO: 161 - protein, 12 aa, Artificial Sequence
  N terminal RuvC-like domain
DLGSNSLGWFVT

SEQ ID NO: 162 - protein, 12 aa, Artificial Sequence
  N terminal RuvC-like domain
DLGANSLGWFVV

SEQ ID NO: 163-170 - skipped (8 entries)

SEQ ID NO: 171 - protein, 15 aa, Artificial Sequence
  N terminal RuvC-like domain
DIGLRIGITSCGWSI

SEQ ID NO: 172 - protein, 12 aa, Artificial Sequence
  N terminal RuvC-like domain
DMGAKYTGVFYA

SEQ ID NO: 173 - protein, 12 aa, Artificial Sequence
  N terminal RuvC-like domain
DLGGKNTGFFSF

SEQ ID NO: 174 - protein, 12 aa, Artificial Sequence
  N terminal RuvC-like domain
DLGVKNTGVFSA

SEQ ID NO: 175 - protein, 12 aa, Artificial Sequence
  N terminal RuvC-like domain
DLGAKFTGVALY

SEQ ID NO: 176 - protein, 12 aa, Artificial Sequence
  N terminal RuvC-like domain
DLGGKFTGVCLS

SEQ ID NO: 177 - protein, 12 aa, Artificial Sequence
  N terminal RuvC-like domain
DLGGTYTGTFIT

SEQ ID NO: 178 - protein, 28 aa, Artificial Sequence
  HNH-like domain
YDIDHIYPRSLTKDDSFDNLVLCERTAN

SEQ ID NO: 179 - protein, 28 aa, Artificial Sequence
  HNH-like domain
DIDHIYPRSKVIKDDSFDNLVLVLKNEN

SEQ ID NO: 180 - protein, 27 aa, Artificial Sequence
  HNH-like domain
DRDHIYPQSKIKDDSIDNLVLVNKTYN

SEQ ID NO: 181 - protein, 27 aa, Artificial Sequence
  HNH-like domain
DIDHIYPRSKIKDDSITNRVLVEKDIN

SEQ ID NO: 182 - protein, 27 aa, Artificial Sequence
  HNH-like domain
DIDHIYPQSKIKDDSISNRVLVCSSCN

SEQ ID NO: 183 - protein, 27 aa, Artificial Sequence
  HNH-like domain
DIDHIYPQSKTMDDSLNNRVLVKKNYN

SEQ ID NO: 184 - protein, 27 aa, Artificial Sequence
  HNH-like domain
DQDHIYPKSKIYDDSLENRVLVKKNLN

SEQ ID NO: 185 - protein, 27 aa, Artificial Sequence
  HNH-like domain
QIDHIVPQSLVKDDSFDNRVLVVPSEN

SEQ ID NO: 186 - protein, 27 aa, Artificial Sequence
  HNH-like domain
DIDHIIPQAFIKDNSIDNRVLTSSKEN

SEQ ID NO: 187 - protein, 27 aa, Artificial Sequence
  HNH-like domain
DIDHIIPQAFLKDNSIDNKVLVSSASN

SEQ ID NO: 188 - protein, 27 aa, Artificial Sequence
  HNH-like domain
DIDHIIPQAYTKDNSLDNRVLVSNITN

SEQ ID NO: 189 - protein, 27 aa, Artificial Sequence
  HNH-like domain
DIDHIVPQSFITDNSIDNLVLTSSAGN

SEQ ID NO: 190 - protein, 27 aa, Artificial Sequence
  HNH-like domain
DVDHIVPQSFLKDDSIDNKVLTRSDKN

SEQ ID NO: 191 - protein, 27 aa, Artificial Sequence
  HNH-like domain
NIDHIYPQSMVKDDSLDNKVLVQSEIN

SEQ ID NO: 192 - protein, 27 aa, Artificial Sequence
  HNH-like domain
DIDHILPQSLIKDDSLDNRVLVNATIN

SEQ ID NO: 193 - protein, 27 aa, Artificial Sequence
  HNH-like domain
DIDHILPQSFIKDDSLENRVLVKKAVN

SEQ ID NO: 194 - protein, 27 aa, Artificial Sequence
  HNH-like domain
EVDHIFPRSFIKDDSIDNKVLVIKKMN

SEQ ID NO: 195 - protein, 27 aa, Artificial Sequence
  HNH-like domain
EVDHIIPRSYIKDDSFENKVLVYREEN

SEQ ID NO: 196 - protein, 27 aa, Artificial Sequence
  HNH-like domain
DIDHIIPQAVTQNDSIDNRVLVARAEN

SEQ ID NO: 197 - protein, 27 aa, Artificial Sequence
  HNH-like domain
EIDHIIPYSISFDDSSSNKLLVLAESN

SEQ ID NO: 198 - protein, 27 aa, Artificial Sequence
  HNH-like domain
EIDHIIPYSLCFDDSSANKVLVHKQSN

SEQ ID NO: 199 - protein, 27 aa, Artificial Sequence
  HNH-like domain
DIDHIIPYSRSMDDSYSNKVLVLSGEN

SEQ ID NO: 200 - protein, 27 aa, Artificial Sequence
  HNH-like domain
DIDHIIPYSKSMDDSFNNKVLCLAEEN

SEQ ID NO: 201 - protein, 27 aa, Artificial Sequence
  HNH-like domain
EIDHIYPYSRSFDDSYMNKVLVFTKQN

SEQ ID NO: 202 - protein, 27 aa, Artificial Sequence
  HNH-like domain
QIDHIYPYSRSMDDSYMNKVLVLTDEN

SEQ ID NO: 203 - protein, 27 aa, Artificial Sequence
  HNH-like domain
EIDHIIPFSRSFDDSLSNKILVLGSEN

SEQ ID NO: 204 - protein, 27 aa, Artificial Sequence
  HNH-like domain
EIDHALPFSRTWDDSFNNKVLVLGSEN

SEQ ID NO: 205 - protein, 27 aa, Artificial Sequence
  HNH-like domain
EIDHALPFSRTWDDSFNNKVLVLASEN

SEQ ID NO: 206 - protein, 27 aa, Artificial Sequence
  HNH-like domain
EIDHIIPISISLDDSINNKVLVLSKAN

SEQ ID NO: 207 - protein, 27 aa, Artificial Sequence
  HNH-like domain
EVDHIIPISISLDDSITNKVLVTHREN

SEQ ID NO: 208 - protein, 27 aa, Artificial Sequence
  HNH-like domain
QVDHALPYSRSYDDSKNNKVLVLTHEN

SEQ ID NO: 209 - protein, 27 aa, Artificial Sequence
  HNH-like domain
EVDHILPLSITFDDSLANKVLVYATAN

SEQ ID NO: 210 - protein, 27 aa, Artificial Sequence
  HNH-like domain
EIDHIIPRSISFDDARSNKVLVYRSEN

SEQ ID NO: 211 - protein, 27 aa, Artificial Sequence
  HNH-like domain
EVDHIIPRSVSFDNSYHNKVLVKQSEN

SEQ ID NO: 212 - protein, 27 aa, Artificial Sequence
  HNH-like domain
DIDHILPYSITFDDSFRNKVLVTSQEN

SEQ ID NO: 213 - protein, 27 aa, Artificial Sequence
  HNH-like domain
EIDHILPRSRSADDSFANKVLCLARAN

SEQ ID NO: 214 - protein, 27 aa, Artificial Sequence
  HNH-like domain
EIEHLLPFSLTLDDSMANKTVCFRQAN

SEQ ID NO: 215 - protein, 27 aa, Artificial Sequence
  HNH-like domain
DIDHILPFSVSLDDSAANKVVCLREAN

SEQ ID NO: 216 - protein, 27 aa, Artificial Sequence
  HNH-like domain
DIDHLIPFSISWDDSAANKVVCMRYAN

SEQ ID NO: 217 - protein, 27 aa, Artificial Sequence
  HNH-like domain
DIDHILPVAMTLDDSPANKIICMRYAN

SEQ ID NO: 218 - protein, 27 aa, Artificial Sequence
  HNH-like domain
DVDHILPYSRTLDDSFPNRTLCLREAN

SEQ ID NO: 219 - protein, 27 aa, Artificial Sequence
  HNH-like domain
EIEHILPFSRTLDDSLNNRTVAMRRAN

SEQ ID NO: 220 - protein, 27 aa, Artificial Sequence
  HNH-like domain
EVDHIIPYSISWDDSYTNKVLTSAKCN

SEQ ID NO: 221 - protein, 27 aa, Artificial Sequence
  HNH-like domain
QVDHILPWSRFGDDSYLNKTLCTARSN

SEQ ID NO: 222 - protein, 27 aa, Artificial Sequence
  HNH-like domain
QVDHILPFSKTLDDSFANKVLAQHDAN

SEQ ID NO: 223 - protein, 27 aa, Artificial Sequence
  HNH-like domain
QIDHAFPLSRSLDDSQSNKVLCLTSSN

SEQ ID NO: 224 - protein, 27 aa, Artificial Sequence
  HNH-like domain
DIDHIVPRSISFDDSFSNLVIVNKLDN

SEQ ID NO: 225 - protein, 27 aa, Artificial Sequence
  HNH-like domain
EIEHIIPYSMSYDNSQANKILTEKAEN

SEQ ID NO: 226 - protein, 27 aa, Artificial Sequence
  HNH-like domain
EIDHVIPYSKSADDSWFNKLLVKKSTN

SEQ ID NO: 227 - protein, 27 aa, Artificial Sequence
  HNH-like domain
EMDHILPYSRSLDNGWHNRVLVHGKDN

SEQ ID NO: 228 - protein, 27 aa, Artificial Sequence
  HNH-like domain
EVDHIVPYSLILDNTINNKALVYAEEN

SEQ ID NO: 229 - protein, 27 aa, Artificial Sequence
  HNH-like domain
EIEHVIPQSLYFDDSFSNKVICEAEVN

SEQ ID NO: 230 - protein, 27 aa, Artificial Sequence
  HNH-like domain
DIEHIIPQARLFDDSFSNKTLEARSVN

SEQ ID NO: 231 - protein, 27 aa, Artificial Sequence
  HNH-like domain
EIEHIVPKARVFDDSFSNKTLTFHRIN

SEQ ID NO: 232 - protein, 28 aa, Artificial Sequence
  HNH-like domain
DKDHIIPQSMKKDDSIINNLVLVNKNAN

SEQ ID NO: 233 - protein, 27 aa, Artificial Sequence
  HNH-like domain
EVEHIWPRSRSFDNSPRNKTLCRKDVN

SEQ ID NO: 234 - protein, 27 aa, Artificial Sequence
  HNH-like domain
IVNHIIPYNRSFDDTYHNRVLTLTETK

SEQ ID NO: 235 - protein, 27 aa, Artificial Sequence
  HNH-like domain
DMEHTIPKSISFDNSDQNLTLCESYYN

SEQ ID NO: 236 - protein, 27 aa, Artificial Sequence
  HNH-like domain
DIEHTIPRSAGGDSTKMNLTLCSSRFN

SEQ ID NO: 237 - protein, 27 aa, Artificial Sequence
  HNH-like domain
DIEHTIPRSISQDNSQMNKTLCSLKFN

SEQ ID NO: 238 - protein, 27 aa, Artificial Sequence
  HNH-like domain
DIDHVIPLARGGRDSLDNMVLCQSDAN

SEQ ID NO: 239 - protein, 27 aa, Artificial Sequence
  HNH-like domain
DIEHLFPIAESEDNGRNNLVISHSACN

SEQ ID NO: 240 - protein, 27 aa, Artificial Sequence
  HNH-like domain
DVDHIFPRDDTADNSYGNKVVAHRQCN

SEQ ID NO: 241 - protein, 27 aa, Artificial Sequence
  HNH-like domain
DIEHIVPQSLGGLSTDYNTIVTLKSVN

SEQ ID NO: 242 - protein, 27 aa, Artificial Sequence
  HNH-like domain
ELDHIVPRTDGGSNRHENLAITCGACN

SEQ ID NO: 243 - protein, 28 aa, Artificial Sequence
  HNH-like domain
EMDHIVPRKGVGSTNTRTNFAAVCAECN

SEQ ID NO: 244 - protein, 28 aa, Artificial Sequence
  HNH-like domain
EMDHIVPRKGVGSTNTRVNLAAACAACN

SEQ ID NO: 245 - protein, 28 aa, Artificial Sequence
  HNH-like domain
EMDHIVPRAGQGSTNTRENLVAVCHRCN

SEQ ID NO: 246 - protein, 33 aa, Artificial Sequence
  HNH-like domain
EIDHILPRSLIKDARGIVFNAEPNLIYASSRGN

SEQ ID NO: 247 - protein, 33 aa, Artificial Sequence
  HNH-like domain
EIDHIIPRSLTGRTKKTVFNSEANLIYCSSKGN

SEQ ID NO: 248 - protein, 33 aa, Artificial Sequence
  HNH-like domain
EIDHIIPRSLTLKKSESIYNSEVNLIFVSAQGN

SEQ ID NO: 249 - protein, 33 aa, Artificial Sequence
  HNH-like domain
EIDHIYPRSLSKKHFGVIFNSEVNLIYCSSQGN

SEQ ID NO: 250 - protein, 33 aa, Artificial Sequence
  HNH-like domain
EIDHILPRSHTLKIYGTVFNPEGNLIYVHQKCN

SEQ ID NO: 251 - protein, 30 aa, Artificial Sequence
  HNH-like domain
ELDHIIPRSHKKYGTLNDEANLICVTRGDN

SEQ ID NO: 252 - protein, 27 aa, Artificial Sequence
  HNH-like domain
ELEHIVPHSFRQSNALSSLVLTWPGVN

SEQ ID NO: 253-302 - skipped (50 entries)

SEQ ID NO: 303 - DNA, 3333 bp, Neisseria meningitidis
atggtgcctaagaagaagagaaaggtggctgccttcaaacctaattcaatcaactacatcctcggcctcgatatcggcatcgcatccgtcggctgggcgatggtagaaattgacgaagaagaaaaccccatccgcctgattgatttgggcgtgcgcgtatttgagcgtgccgaagtaccgaaaacaggcgactcccttgccatggcaaggcgtttggcgcgcagtgttcgccgcctgacccgccgtcgcgcccaccgcctgcttcggacccgccgcctattgaaacgcgaaggcgtattacaagccgccaattttgacgaaaacggcttgattaaatccttaccgaatacaccatggcaacttcgcgcagccgcattagaccgcaaactgacgcctttagagtggtcggcagtcttgttgcatttaatcaaacatcgcggctatttatcgcaacggaaaaacgagggcgaaactgccgataaggagcttggcgctttgcttaaaggcgtagccggcaatgcccatgccttacagacaggcgatttccgcacaccggccgaattggctttaaataaatttgagaaagaaagcggccatatccgcaatcagcgcagcgattattcgcatacgttcagccgcaaagatttacaggcggagctgattttgctgtttgaaaaacaaaaagaatttggcaatccgcatgtttcaggcggccttaaagaaggtattgaaaccctactgatgacgcaacgccctgccctgtccggcgatgccgttcaaaaaatgttggggcattgcaccttcgaaccggcagagccgaaagccgctaaaaacacctacacagccgaacgtttcatctggctgaccaagctgaacaacctgcgtattttagagcaaggcagcgagcggccattgaccgataccgaacgcgccacgcttatggacgagccatacagaaaatccaaactgacttacgcacaagcccgtaagctgctgggtttagaagataccgcctttttcaaaggcttgcgctatggtaaagacaatgccgaagcctcaacattgatggaaatgaaggcctaccatgccatcagccgtgcactggaaaaagaaggattgaaagacaaaaaatccccattaaacctttctcccgaattacaagacgaaatcggcacggcattctccctgttcaaaaccgatgaagacattacaggccgtctgaaagaccgtatacagcccgaaatcttagaagcgctgttgaaacacatcagcttcgataagttcgtccaaatttccttgaaagcattgcgccgaattgtgcctctaatggaacaaggcaaacgttacgatgaagcctgcgccgaaatctacggagaccattacggcaagaagaatacggaagaaaagatttatctgccgccgattcccgccgacgaaatccgcaaccccgtcgtcttgcgcgccttatctcaagcacgtaaggtcattaacggcgtggtacgccgttacggctccccagctcgtatccatattgaaactgcaagggaagtaggtaaatcgtttaaagaccgcaaagaaattgagaaacgccaagaagaaaaccgcaaagaccgggaaaaagccgccgccaaattccgagagtatttccccaattttgtcggagaacccaaatccaaagatattctgaaactgcgcctgtacgagcaacaacacggcaaatgcctgtattcgggcaaagaaatcaacttaggccgtctgaacgaaaaaggctatgtcgaaatcgaccatgccctgccgttctcgcgcacatgggacgacagtttcaacaataaagtactggtattgggcagcgaaaaccaaaacaaaggcaatcaaaccccttacgaatacttcaacggcaaagacaacagccgcgaatggcaggaatttaaagcgcgtgtcgaaaccagccgtttcccgcgcagtaaaaaacaacggattctgctgcaaaaattcgatgaagacggctttaaagaacgcaatctgaacgacacgcgctacgtcaaccgtttcctgtgtcaatttgttgccgaccgtatgcggctgacaggtaaaggcaagaaacgtgtctttgcatccaacggacaaattaccaatctgttgcgcggcttttggggattgcgcaaagtgcgtgcggaaaacgaccgccatcacgccttggacgccgtcgtcgttgcctgctcgaccgttgccatgcagcagaaaattacccgttttgtacgctataaagagatgaacgcgtttgacggtaaaaccatagacaaagaaacaggagaagtgctgcatcaaaaaacacacttcccacaaccttgggaatttttcgcacaagaagtcatgattcgcgtcttcggcaaaccggacggcaaacccgaattcgaagaagccgataccctagaaaaactgcgcacgttgcttgccgaaaaattatcatctcgccccgaagccgtacacgaatacgttacgccactgtttgtttcacgcgcgcccaatcggaagatgagcgggcaagggcatatggagaccgtcaaatccgccaaacgactggacgaaggcgtcagcgtgttgcgcgtaccgctgacacagttaaaactgaaagacttggaaaaaatggtcaatcgggagcgcgaacctaagctatacgaagcactgaaagcacggctggaagcacataaagacgatcctgccaaagcctttgccgagccgttttacaaatacgataaagcaggcaaccgcacccaacaggtaaaagccgtacgcgtagagcaagtacagaaaaccggcgtatgggtgcgcaaccataacggtattgccgacaacgcaaccatggtgcgcgtagatgtgtttgagaaaggcgacaagtattatctggtaccgatttacagttggcaggtagcgaaagggattttgccggatagggctgttgtacaaggaaaagatgaagaagattggcaacttattgatgatagtttcaactttaaattctcattacaccctaatgatttagtcgaggttataacaaaaaaagctagaatgtttggttactttgccagctgccatcgaggcacaggtaatatcaatatacgcattcatgatcttgatcataaaattggcaaaaatggaatactggaaggtatcggcgtcaaaaccgccctttcattccaaaaataccaaattgacgaactgggcaaagaaatcagaccatgccgtctgaaaaaacgcccgcctgtccgttacccatacgatgttccagattacgctgcagctccagcagcgaagaaaaagaagctggattaa

SEQ ID NO: 304-305 - skipped (2 entries)

SEQ ID NO: 306 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 307 - protein, 1436 aa, Bacteroides fragilis
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKENYTEWNKEKGKTEQQEREHKLEGIYSKRKRDEAKRENLQWRVNGLKEKLSLEQLVIVFQEMNTQINNSSGYLGAISDRSKELYFNKQTVGQYQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSALFEELNDAEQLELNGSRRLCQEEKELLAQELFIRDKMTKSEVLKLLFDNPQELDLNFKTIDGNKTGYALFQAYSKMIEMSGHEPVDFKKPVEKVVEYIKAVFDLLNWNTDILGFNSNEELDNQPYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKAHEEYKTLLQTEFGLTNVSRTDILRYKLYKELESCGYKTLYSNTYISREKLFSKEFDIEHIIPQARLFDDSFSNKTLEARSVNIEKGNKTAYDFVKEKFGESGADNSLEHYLNNIEDLFKSGKISKTKYNKLKMAEQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEEKVNASFDMRKIGTVSKSAYRDALLKRLYENDNDPKKAFAGKNSLDKQPIWLDKEQMRKVPEKVKIVTLEAIYTIRKEISPDLKVDKVIDVGVRKILIDRLNEYGNDAKKAFSNLDKNPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGLPIIDKDYKTTEGWQFLFSMKQNEYFVFPNEKTGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 308 - protein, 1420 aa, Bifidobacterium bifidum
MSRKNYVDDYAISLDIGNASVGWSAFTPNYRLVRAKGHELIGVRLFDPADTAESRRMARTTRRRYSRRRWRLRLLDALFDQALSEIDPSFLARRKYSWVHPDDENNADCWYGSVLFDSNEQDKRFYEKYPTIYHLRKALMEDDSQHDIREIYLAIHHMVKYRGNFLVEGTLESSNAFKEDELLKLLGRITRYEMSEGEQNSDIEQDDENKLVAPANGQLADALCATRGSRSMRVDNALEALSAVNDLSREQRAIVKAIFAGLEGNKLDLAKIFVSKEFSSENKKILGIYFNKSDYEEKCVQIVDSGLLDDEEREFLDRMQGQYNAIALKQLLGRSTSVSDSKCASYDAHRANWNLIKLQLRTKENEKDINENYGILVGWKIDSGQRKSVRGESAYENMRKKANVFFKKMIETSDLSETDKNRLIHDIEEDKLFPIQRDSDNGVIPHQLHQNELKQIIKKQGKYYPFLLDAFEKDGKQINKIEGLLTFRVPYFVGPLVVPEDLQKSDNSENHWMVRKKKGEITPWNFDEMVDKDASGRKFIERLVGTDSYLLGEPTLPKNSLLYQEYEVLNELNNVRLSVRTGNHWNDKRRMRLGREEKTLLCQRLFMKGQTVTKRTAENLLRKEYGRTYELSGLSDESKFTSSLSTYGKMCRIFGEKYVNEHRDLMEKIVELQTVFEDKETLLHQLRQLEGISEADCALLVNTHYTGWGRLSRKLLTTKAGECKISDDFAPRKHSIIEIMRAEDRNLMEIITDKQLGFSDWIEQENLGAENGSSLMEVVDDLRVSPKVKRGIIQSIRLIDDISKAVGKRPSRIFLELADDIQPSGRTISRKSRLQDLYRNANLGKEFKGIADELNACSDKDLQDDRLFLYYTQLGKDMYTGEELDLDRLSSAYDIDHIIPQAVTQNDSIDNRVLVARAENARKTDSFTYMPQIADRMRNFWQILLDNGLISRVKFERLTRQNEFSEREKERFVQRSLVETRQIMKNVATLMRQRYGNSAAVIGLNAELTKEMHRYLGFSHKNRDINDYHHAQDALCVGIAGQFAANRGFFADGEVSDGAQNSYNQYLRDYLRGYREKLSAEDRKQGRAFGFIVGSMRSQDEQKRVNPRTGEVVWSEEDKDYLRKVMNYRKMLVTQKVGDDFGALYDETRYAATDPKGIKGIPFDGAKQDTSLYGGFSSAKPAYAVLIESKGKTRLVNVTMQEYSLLGDRPSDDELRKVLAKKKSEYAKANILLRHVPKMQLIRYGGGLMVIKSAGELNNAQQLWLPYEEYCYFDDLSQGKGSLEKDDLKKLLDSILGSVQCLYPWHRFTEEELADLHVAFDKLPEDEKKNVITGIVSALHADAKTANLSIVGMTGSWRRMNNKSGYTFSDEDEFIFQSPSGLFEKRVTVGELKRKAKKEVNSKYRTNEKRLPTLSGASQP

SEQ ID NO: 309 - protein, 1397 aa, Veillonella atypica
METQTSNQLITSHLKDYPKQDYFVGLDIGTNSVGWAVTNTSYELLKFHSHKMWGSRLFEEGESAVTRRGFRSMRRRLERRKLRLKLLEELFADAMAQVDSTFFIRLHESKYHYEDKTTGHSSKHILFIDEDYTDQDYFTEYPTIYHLRKDLMENGTDDIRKLFLAVHHILKYRGNFLYEGATFNSNAFTFEDVLKQALVNITFNCFDTNSAISSISNILMESGKTKSDKAKAIERLVDTYTVFDEVNTPDKPQKEQVKEDKKTLKAFANLVLGLSANLIDLFGSVEDIDDDLKKLQIVGDTYDEKRDELAKVWGDEIHIIDDCKSVYDAIILMSIKEPGLTISQSKVKAFDKHKEDLVILKSLLKLDRNVYNEMFKSDKKGLHNYVHYIKQGRTEETSCSREDFYKYTKKIVEGLADSKDKEYILNEIELQTLLPLQRIKDNGVIPYQLHLEELKVILDKCGPKFPFLHTVSDGFSVTEKLIKMLEFRIPYYVGPLNTHHNIDNGGFSWAVRKQAGRVTPWNFEEKIDREKSAAAFIKNLTNKCTYLFGEDVLPKSSLLYSEFMLLNELNNVRIDGKALAQGVKQHLIDSIFKQDHKKMTKNRIELFLKDNNYITKKHKPEITGLDGEIKNDLTSYRDMVRILGNNFDVSMAEDIITDITIFGESKKMLRQTLRNKFGSQLNDETIKKLSKLRYRDWGRLSKKLLKGIDGCDKAGNGAPKTIIELMRNDSYNLMEILGDKFSFMECIEEENAKLAQGQVVNPHDIIDELALSPAVKRAVWQALRIVDEVAHIKKALPSRIFVEVARTNKSEKKKKDSRQKRLSDLYSAIKKDDVLQSGLQDKEFGALKSGLANYDDAALRSKKLYLYYTQMGRCAYTGNIIDLNQLNTDNYDIDHIYPRSLTKDDSFDNLVLCERTANAKKSDIYPIDNRIQTKQKPFWAFLKHQGLISERKYERLTRIAPLTADDLSGFIARQLVETNQSVKATTTLLRRLYPDIDVVFVKAENVSDFRHNNNFIKVRSLNHHHHAKDAYLNIVVGNVYHEKFTRNFRLFFKKNGANRTYNLAKMFNYDVICTNAQDGKAWDVKTSMNTVKKMMASNDVRVTRRLLEQSGALADATIYKASVAAKAKDGAYIGMKTKYSVFADVTKYGGMTKIKNAYSIIVQYTGKKGEEIKEIVPLPIYLINRNATDIELIDYVKSVIPKAKDISIKYRKLCINQLVKVNGFYYYLGGKTNDKIYIDNAIELVVPHDIATYIKLLDKYDLLRKENKTLKASSITTSIYNINTSTVVSLNKVGIDVFDYFMSKLRTPLYMKMKGNKVDELSSTGRSKFIKMTLEEQSIYLLEVLNLLTNSKTTFDVKPLGITGSRSTIGVKIHNLDEFKIINESITGLYSNEVTIV

SEQ ID NO: 310 - protein, 1363 aa, Lactobacillus rhamnosus
MTKLNQPYGIGLDIGSNSIGFAVVDANSHLLRLKGETAIGARLFREGQSAADRRGSRTTRRRLSRTRWRLSFLRDFFAPHITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQELYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPIQLQQRELDQIIANQSKYYDWLAAPNPVEAHRWKMPYQLDELLNFHIPYYVGPLITPKQQAESGENVFAWMVRKDPSGNITPYNFDEKVDREASANTFIQRMKTTDTYLIGEDVLPKQSLLYQKYEVLNELNNVRINNECLGTDQKQRLIREVFERHSSVTIKQVADNLVAHGDFARRPEIRGLADEKRFLSSLSTYHQLKEILHEAIDDPTKLLDIENIITWSTVFEDHTIFETKLAEIEWLDPKKINELSGIRYRGWGQFSRKLLDGLKLGNGHTVIQELMLSNHNLMQILADETLKETMTELNQDKLKTDDIEDVINDAYTSPSNKKALRQVLRVVEDIKHAANGQDPSWLFIETADGTGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFAGKMKATWRKWHEAGLISGRKLRNLMLRPDEIDKFAKGFVARQLVETRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIIAKDTGEIVWDKERDIRELDRIYNFKRMLITHEVYFETADLFKQTIYAAKDSKERGGSKQLIPKKQGYPTQVYGGYTQESGSYNALVRVAEADTTAYQVIKISAQNASKIASANLKSREKGKQLLNEIVVKQLAKRRKNWKPSANSFKIVIPRFGMGTLFQNAKYGLFMVNSDTYYRNYQELWLSRENQKLLKKLFSIKYEKTQMNHDALQVYKAIIDQVEKFFKLYDINQFRAKLSDAIERFEKLPINTDGNKIGKTETLRQILIGLQANGTRSNVKNLGIKTDLGLLQVGSGIKLDKDTQIVYQSPSGLFKRRIPLADL

SEQ ID NO: 311 - protein, 1365 aa, Filifactor alocis
MTKEYYLGLDVGTNSVGWAVTDSQYNLCKFKKKDMWGIRLFESANTAKDRRLQRGNRRRLERKKQRIDLLQEIFSPEICKIDPTFFIRLNESRLHLEDKSNDFKYPLFIEKDYSDIEYYKEFPTIFHLRKHLIESEEKQDIRLIYLALHNIIKTRGHFLIDGDLQSAKQLRPILDTFLLSLQEEQNLSVSLSENQKDEYEEILKNRSIAKSEKVKKLKNLFEISDELEKEEKKAQSAVIENFCKFIVGNKGDVCKFLRVSKEELEIDSFSFSEGKYEDDIVKNLEEKVPEKVYLFEQMKAMYDWNILVDILETEEYISFAKVKQYEKHKTNLRLLRDIILKYCTKDEYNRMFNDEKEAGSYTAYVGKLKKNNKKYWIEKKRNPEEFYKSLGKLLDKIEPLKEDLEVLTMMIEECKNHTLLPIQKNKDNGVIPHQVHEVELKKILENAKKYYSFLTETDKDGYSVVQKIESIFRFRIPYYVGPLSTRHQEKGSNVWMVRKPGREDRIYPWNMEEIIDFEKSNENFITRMTNKCTYLIGEDVLPKHSLLYSKYMVLNELNNVKVRGKKLPTSLKQKVFEDLFENKSKVTGKNLLEYLQIQDKDIQIDDLSGFDKDFKTSLKSYLDFKKQIFGEEIEKESIQNMIEDIIKWITIYGNDKEMLKRVIRANYSNQLTEEQMKKITGFQYSGWGNFSKMFLKGISGSDVSTGETFDIITAMWETDNNLMQILSKKFTFMDNVEDFNSGKVGKIDKITYDSTVKEMFLSPENKRAVWQTIQVAEEIKKVMGCEPKKIFIEMARGGEKVKKRTKSRKAQLLELYAACEEDCRELIKEIEDRDERDFNSMKLFLYYTQFGKCMYSGDDIDINELIRGNSKWDRDHIYPQSKIKDDSIDNLVLVNKTYNAKKSNELLSEDIQKKMHSFWLSLLNKKLITKSKYDRLTRKGDFTDEELSGFIARQLVETRQSTKAIADIFKQIYSSEVVYVKSSLVSDFRKKPLNYLKSRRVNDYHHAKDAYLNIVVGNVYNKKFTSNPIQWMKKNRDTNYSLNKVFEHDVVINGEVIWEKCTYHEDTNTYDGGTLDRIRKIVERDNILYTEYAYCEKGELFNATIQNKNGNSTVSLKKGLDVKKYGGYFSANTSYFSLIEFEDKKGDRARHIIGVPIYIANMLEHSPSAFLEYCEQKGYQNVRILVEKIKKNSLLIINGYPLRIRGENEVDTSFKRAIQLKLDQKNYELVRNIEKFLEKYVEKKGNYPIDENRDHITHEKMNQLYEVLLSKMKKFNKKGMADPSDRIEKSKPKFIKLEDLIDKINVINKMLNLLRCDNDTKADLSLIELPKNAGSFVVKKNTIGKSKIILVNQSVTGLYENRREL

SEQ ID NO: 312 - protein, 1389 aa, Oenococcus kitaharae
MARDYSVGLDIGTSSVGWAAIDNKYHLIRAKSKNLIGVRLFDSAVTAEKRRGYRTTRRRLSRRHWRLRLLNDIFAGPLTDFGDENFLARLKYSWVHPQDQSNQAHFAAGLLFDSKEQDKDFYRKYPTIYHLRLALMNDDQKHDLREVYLAIHHLVKYRGHFLIEGDVKADSAFDVHTFADAIQRYAESNNSDENLLGKIDEKKLSAALTDKHGSKSQRAETAETAFDILDLQSKKQIQAILKSVVGNQANLMAIFGLDSSAISKDEQKNYKFSFDDADIDEKIADSEALLSDTEFEFLCDLKAAFDGLTLKMLLGDDKTVSAAMVRRFNEHQKDWEYIKSHIRNAKNAGNGLYEKSKKFDGINAAYLALQSDNEDDRKKAKKIFQDEISSADIPDDVKADFLKKIDDDQFLPIQRTKNNGTIPHQLHRNELEQIIEKQGIYYPFLKDTYQENSHELNKITALINFRVPYYVGPLVEEEQKIADDGKNIPDPTNHWMVRKSNDTITPWNLSQVVDLDKSGRRFIERLTGTDTYLIGEPTLPKNSLLYQKFDVLQELNNIRVSGRRLDIRAKQDAFEHLFKVQKTVSATNLKDFLVQAGYISEDTQIEGLADVNGKNFNNALTTYNYLVSVLGREFVENPSNEELLEEITELQTVFEDKKVLRRQLDQLDGLSDHNREKLSRKHYTGWGRISKKLLTTKIVQNADKIDNQTFDVPRMNQSIIDTLYNTKMNLMEIINNAEDDFGVRAWIDKQNTTDGDEQDVYSLIDELAGPKEIKRGIVQSFRILDDITKAVGYAPKRVYLEFARKTQESHLTNSRKNQLSTLLKNAGLSELVTQVSQYDAAALQNDRLYLYFLQQGKDMYSGEKLNLDNLSNYDIDHIIPQAYTKDNSLDNRVLVSNITNRRKSDSSNYLPALIDKMRPFWSVLSKQGLLSKHKFANLTRTRDFDDMEKERFIARSLVETRQIIKNVASLIDSHFGGETKAVAIRSSLTADMRRYVDIPKNRDINDYHHAFDALLFSTVGQYTENSGLMKKGQLSDSAGNQYNRYIKEWIHAARLNAQSQRVNPFGFVVGSMRNAAPGKLNPETGEITPEENADWSIADLDYLHKVMNFRKITVTRRLKDQKGQLYDESRYPSVLHDAKSKASINFDKHKPVDLYGGFSSAKPAYAALIKFKNKFRLVNVLRQWTYSDKNSEDYILEQIRGKYPKAEMVLSHIPYGQLVKKDGALVTISSATELHNFEQLWLPLADYKLINTLLKTKEDNLVDILHNRLDLPEMTIESAFYKAFDSILSFAFNRYALHQNALVKLQAHRDDFNALNYEDKQQTLERILDALHASPASSDLKKINLSSGFGRLFSPSHFTLADTDEFIFQSVTGLFSTQKTVAQLYQETK

SEQ ID NO: 313 - protein, 1323 aa, Fructobacillus fructosus
MVYDVGLDIGTGSVGWVALDENGKLARAKGKNLVGVRLFDTAQTAADRRGFRTTRRRLSRRKWRLRLLDELFSAEINEIDSSFFQRLKYSYVHPKDEENKAHYYGGYLFPTEEETKKFHRSYPTIYHLRQELMAQPNKRFDIREIYLAIHHLVKYRGHFLSSQEKITIGSTYNPEDLANAIEVYADEKGLSWELNNPEQLTEIISGEAGYGLNKSMKADEALKLFEFDNNQDKVAIKTLLAGLTGNQIDFAKLFGKDISDKDEAKLWKLKLDDEALEEKSQTILSQLTDEEIELFHAVVQAYDGFVLIGLLNGADSVSAAMVQLYDQHREDRKLLKSLAQKAGLKHKRFSEIYEQLALATDEATIKNGISTARELVEESNLSKEVKEDTLRRLDENEFLPKQRTKANSVIPHQLHLAELQKILQNQGQYYPFLLDTFEKEDGQDNKIEELLRFRIPYYVGPLVTKKDVEHAGGDADNHWVERNEGFEKSRVTPWNFDKVFNRDKAARDFIERLTGNDTYLIGEKTLPQNSLRYQLFTVLNELNNVRVNGKKFDSKTKADLINDLFKARKTVSLSALKDYLKAQGKGDVTITGLADESKFNSSLSSYNDLKKTFDAEYLENEDNQETLEKIIEIQTVFEDSKIASRELSKLPLDDDQVKKLSQTHYTGWGRLSEKLLDSKIIDERGQKVSILDKLKSTSQNFMSIINNDKYGVQAWITEQNTGSSKLTFDEKVNELTTSPANKRGIKQSFAVLNDIKKAMKEEPRRVYLEFAREDQTSVRSVPRYNQLKEKYQSKSLSEEAKVLKKTLDGNKNKMSDDRYFLYFQQQGKDMYTGRPINFERLSQDYDIDHIIPQAFTKDDSLDNRVLVSRPENARKSDSFAYTDEVQKQDGSLWTSLLKSGFINRKKYERLTKAGKYLDGQKTGFIARQLVETRQIIKNVASLIEGEYENSKAVAIRSEITADMRLLVGIKKHREINSFHHAFDALLITAAGQYMQNRYPDRDSTNVYNEFDRYTNDYLKNLRQLSSRDEVRRLKSFGFVVGTMRKGNEDWSEENTSYLRKVMMFKNILTTKKTEKDRGPLNKETIFSPKSGKKLIPLNSKRSDTALYGGYSNVYSAYMTLVRANGKNLLIKIPISIANQIEVGNLKINDYIVNNPAIKKFEKILISKLPLGQLVNEDGNLIYLASNEYRHNAKQLWLSTTDADKIASISENSSDEELLEAYDILTSENVKNRFPFFKKDIDKLSQVRDEFLDSDKRIAVIQTILRGLQIDAAYQAPVKIISKKVSDWHKLQQSGGIKLSDNSEMIYQSATGIFETRVKISDLL

SEQ ID NO: 314 - protein, 1329 aa, Catenibacterium mitsuokai
IVDYCIGLDLGTGSVGWAVVDMNHRLMKRNGKHLWGSRLFSNAETAANRRASRSIRRRYNKRRERIRLLRAILQDMVLEKDPTFFIRLEHTSFLDEEDKAKYLGTDYKDNYNLFIDEDFNDYTYYHKYPTIYHLRKALCESTEKADPRLIYLALHHIVKYRGNFLYEGQKFNMDASNIEDKLSDIFTQFTSFNNIPYEDDEKKNLEILEILKKPLSKKAKVDEVMTLIAPEKDYKSAFKELVTGIAGNKMNVTKMILCEPIKQGDSEIKLKFSDSNYDDQFSEVEKDLGEYVEFVDALHNVYSWVELQTIMGATHTDNASISEAMVSRYNKHHDDLKLLKDCIKNNVPNKYFDMFRNDSEKSKGYYNYINRPSKAPVDEFYKYVKKCIEKVDTPEAKQILNDIELENFLLKQNSRTNGSVPYQMQLDEMIKIIDNQAEYYPILKEKREQLLSILTFRIPYYFGPLNETSEHAWIKRLEGKENQRILPWNYQDIVDVDATAEGFIKRMRSYCTYFPDEEVLPKNSLIVSKYEVYNELNKIRVDDKLLEVDVKNDIYNELFMKNKTVTEKKLKNWLVNNQCCSKDAEIKGFQKENQFSTSLTPWIDFTNIFGKIDQSNFDLIENIIYDLTVFEDKKIMKRRLKKKYALPDDKVKQILKLKYKDWSRLSKKLLDGIVADNRFGSSVTVLDVLEMSRLNLMEIINDKDLGYAQMIEEATSCPEDGKFTYEEVERLAGSPALKRGIWQSLQIVEEITKVMKCRPKYIYIEFERSEEAKERTESKIKKLENVYKDLDEQTKKEYKSVLEELKGFDNTKKISSDSLFLYFTQLGKCMYSGKKLDIDSLDKYQIDHIVPQSLVKDDSFDNRVLVVPSENQRKLDDLVVPFDIRDKMYRFWKLLFDHELISPKKFYSLIKTEYTERDEERFINRQLVETRQITKNVTQIIEDHYSTTKVAAIRANLSHEFRVKNHIYKNRDINDYHHAHDAYIVALIGGFMRDRYPNMHDSKAVYSEYMKMFRKNKNDQKRWKDGFVINSMNYPYEVDGKLIWNPDLINEIKKCFYYKDCYCTTKLDQKSGQLFNLTVLSNDAHADKGVTKAVVPVNKNRSDVHKYGGFSGLQYTIVAIEGQKKKGKKTELVKKISGVPLHLKAASINEKINYIEEKEGLSDVRIIKDNIPVNQMIEMDGGEYLLTSPTEYVNARQLVLNEKQCALIADIYNAIYKQDYDNLDDILMIQLYIELTNKMKVLYPAYRGIAEKFESMNENYVVISKEEKANIIKQMLIVMHRGPQNGNIVYDDFKISDRIGRLKTKNHNLNNIVFISQSPTGIYTKKYKL

SEQ ID NO: 315 - protein, 1348 aa, Finegoldia magna
MKSEKKYYIGLDVGTNSVGWAVTDEFYNILRAKGKDLWGVRLFEKADTAANTRIFRSGRRRNDRKGMRLQILREIFEDEIKKVDKDFYDRLDESKFWAEDKKVSGKYSLFNDKNFSDKQYFEKFPTIFHLRKYLMEEHGKVDIRYYFLAINQMMKRRGHFLIDGQISHVTDDKPLKEQLILLINDLLKIELEEELMDSIFEILADVNEKRTDKKNNLKELIKGQDFNKQEGNILNSIFESIVTGKAKIKNIISDEDILEKIKEDNKEDFVLTGDSYEENLQYFEEVLQENITLFNTLKSTYDFLILQSILKGKSTLSDAQVERYDEHKKDLEILKKVIKKYDEDGKLFKQVFKEDNGNGYVSYIGYYLNKNKKITAKKKISNIEFTKYVKGILEKQCDCEDEDVKYLLGKIEQENFLLKQISSINSVIPHQIHLFELDKILENLAKNYPSFNNKKEEFTKIEKIRKTFTFRIPYYVGPLNDYHKNNGGNAWIFRNKGEKIRPWNFEKIVDLHKSEEEFIKRMLNQCTYLPEETVLPKSSILYSEYMVLNELNNLRINGKPLDTDVKLKLIEELFKKKTKVTLKSIRDYMVRNNFADKEDFDNSEKNLEIASNMKSYIDFNNILEDKFDVEMVEDLIEKITIHTGNKKLLKKYIEETYPDLSSSQIQKIINLKYKDWGRLSRKLLDGIKGTKKETEKTDTVINFLRNSSDNLMQIIGSQNYSFNEYIDKLRKKYIPQEISYEVVENLYVSPSVKKMIWQVIRVTEEITKVMGYDPDKIFIEMAKSEEEKKTTISRKNKLLDLYKAIKKDERDSQYEKLLTGLNKLDDSDLRSRKLYLYYTQMGRDMYTGEKIDLDKLFDSTHYDKDHIIPQSMKKDDSIINNLVLVNKNANQTTKGNIYPVPSSIRNNPKIYNYWKYLMEKEFISKEKYNRLIRNTPLTNEELGGFINRQLVETRQSTKAIKELFEKFYQKSKIIPVKASLASDLRKDMNTLKSREVNDLHHAHDAFLNIVAGDVWNREFTSNPINYVKENREGDKVKYSLSKDFTRPRKSKGKVIWTPEKGRKLIVDTLNKPSVLISNESHVKKGELFNATIAGKKDYKKGKIYLPLKKDDRLQDVSKYGGYKAINGAFFFLVEHTKSKKRIRSIELFPLHLLSKFYEDKNTVLDYAINVLQLQDPKIIIDKINYRTEIIIDNFSYLISTKSNDGSITVKPNEQMYWRVDEISNLKKIENKYKKDAILTEEDRKIMESYIDKIYQQFKAGKYKNRRTTDTIIEKYEIIDLDTLDNKQLYQLLVAFISLSYKTSNNAVDFTVIGLGTECGKPRITNLPDNTYLVYKSITGIYEKRIRIK

SEQ ID NO: 316 - protein, 1384 aa, Coriobacterium glomerans
MKLRGIEDDYSIGLDMGTSSVGWAVTDERGTLAHFKRKPTWGSRLFREAQTAAVARMPRGQRRRYVRRRWRLDLLQKLFEQQMEQADPDFFIRLRQSRLLRDDRAEEHADYRWPLFNDCKFTERDYYQRFPTIYHVRSWLMETDEQADIRLIYLALHNIVKHRGNFLREGQSLSAKSARPDEALNHLRETLRVWSSERGFECSIADNGSILAMLTHPDLSPSDRRKKIAPLFDVKSDDAAADKKLGIALAGAVIGLKTEFKNIFGDFPCEDSSIYLSNDEAVDAVRSACPDDCAELFDRLCEVYSAYVLQGLLSYAPGQTISANMVEKYRRYGEDLALLKKLVKIYAPDQYRMFFSGATYPGTGIYDAAQARGYTKYNLGPKKSEYKPSESMQYDDFRKAVEKLFAKTDARADERYRMMMDRFDKQQFLRRLKTSDNGSIYHQLHLEELKAIVENQGRFYPFLKRDADKLVSLVSFRIPYYVGPLSTRNARTDQHGENRFAWSERKPGMQDEPIFPWNWESIIDRSKSAEKFILRMTGMCTYLQQEPVLPKSSLLYEEFCVLNELNGAHWSIDGDDEHRFDAADREGIIEELFRRKRTVSYGDVAGWMERERNQIGAHVCGGQGEKGFESKLGSYIFFCKDVFKVERLEQSDYPMIERIILWNTLFEDRKILSQRLKEEYGSRLSAEQIKTICKKRFTGWGRLSEKFLTGITVQVDEDSVSIMDVLREGCPVSGKRGRAMVMMEILRDEELGFQKKVDDFNRAFFAENAQALGVNELPGSPAVRRSLNQSIRIVDEIASIAGKAPANIFIEVTRDEDPKKKGRRTKRRYNDLKDALEAFKKEDPELWRELCETAPNDMDERLSLYFMQRGKCLYSGRAIDIHQLSNAGIYEVDHIIPRTYVKDDSLENKALVYREENQRKTDMLLIDPEIRRRMSGYWRMLHEAKLIGDKKFRNLLRSRIDDKALKGFIARQLVETGQMVKLVRSLLEARYPETNIISVKASISHDLRTAAELVKCREANDFHHAHDAFLACRVGLFIQKRHPCVYENPIGLSQVVRNYVRQQADIFKRCRTIPGSSGFIVNSFMTSGFDKETGEIFKDDWDAEAEVEGIRRSLNFRQCFISRMPFEDHGVFWDATIYSPRAKKTAALPLKQGLNPSRYGSFSREQFAYFFIYKARNPRKEQTLFEFAQVPVRLSAQIRQDENALERYARELAKDQGLEFIRIERSKILKNQLIEIDGDRLCITGKEEVRNACELAFAQDEMRVIRMLVSEKPVSRECVISLFNRILLHGDQASRRLSKQLKLALLSEAFSEASDNVQRNVVLGLIAIFNGSTNMVNLSDIGGSKFAGNVRIKYKKELASPKVNVHLIDQSVTGMFERRTKIGL

SEQ ID NO: 317 - protein, 1391 aa, Eubacterium yurii
MENKQYYIGLDVGTNSVGWAVTDTSYNLLRAKGKDMWGARLFEKANTAAERRTKRTSRRRSEREKARKAMLKELFADEINRVDPSFFIRLEESKFFLDDRSENNRQRYTLFNDATFTDKDYYEKYKTIFHLRSALINSDEKFDVRLVFLAILNLFSHRGHFLNASLKGDGDIQGMDVFYNDLVESCEYFEIELPRITNIDNFEKILSQKGKSRTKILEELSEELSISKKDKSKYNLIKLISGLEASVVELYNIEDIQDENKKIKIGFRESDYEESSLKVKEIIGDEYFDLVERAKSVHDMGLLSNIIGNSKYLCEARVEAYENHHKDLLKIKELLKKYDKKAYNDMFRKMTDKNYSAYVGSVNSNIAKERRSVDKRKIEDLYKYIEDTALKNIPDDNKDKIEILEKIKLGEFLKKQLTASNGVIPNQLQSRELRAILKKAENYLPFLKEKGEKNLTVSEMIIQLFEFQIPYYVGPLDKNPKKDNKANSWAKIKQGGRILPWNFEDKVDVKGSRKEFIEKMVRKCTYISDEHTLPKQSLLYEKFMVLNEINNIKIDGEKISVEAKQKIYNDLFVKGKKVSQKDIKKELISLNIMDKDSVLSGTDTVCNAYLSSIGKFTGVFKEEINKQSIVDMIEDIIFLKTVYGDEKRFVKEEIVEKYGDEIDKDKIKRILGFKFSNWGNLSKSFLELEGADVGTGEVRSIIQSLWETNFNLMELLSSRFTYMDELEKRVKKLEKPLSEWTIEDLDDMYLSSPVKRMIWQSMKIVDEIQTVIGYAPKRIFVEMTRSEGEKVRTKSRKDRLKELYNGIKEDSKQWVKELDSKDESYFRSKKMYLYYLQKGRCMYSGEVIELDKLMDDNLYDIDHIYPRSFVKDDSLDNLVLVKKEINNRKQNDPITPQIQASCQGFWKILHDQGFMSNEKYSRLTRKTQEFSDEEKLSFINRQIVETGQATKCMAQILQKSMGEDVDVVFSKARLVSEFRHKFELFKSRLINDFHHANDAYLNIVVGNSYFVKFTRNPANFIKDARKNPDNPVYKYHMDRFFERDVKSKSEVAWIGQSEGNSGTIVIVKKTMAKNSPLITKKVEEGHGSITKETIVGVKEIKFGRNKVEKADKTPKKPNLQAYRPIKTSDERLCNILRYGGRTSISISGYCLVEYVKKRKTIRSLEAIPVYLGRKDSLSEEKLLNYFRYNLNDGGKDSVSDIRLCLPFISTNSLVKIDGYLYYLGGKNDDRIQLYNAYQLKMKKEEVEYIRKIEKAVSMSKFDEIDREKNPVLTEEKNIELYNKIQDKFENTVFSKRMSLVKYNKKDLSFGDFLKNKKSKFEEIDLEKQCKVLYNIIFNLSNLKEVDLSDIGGSKSTGKCRCKKNITNYKEFKLIQQSITGLYSCEKDLMTI

SEQ ID NO: 318 - protein, 1364 aa, Peptoniphilus duerdenii
MKNLKEYYIGLDIGTASVGWAVTDESYNIPKFNGKKMWGVRLFDDAKTAEERRTQRGSRRRLNRRKERINLLQDLFATEISKVDPNFFLRLDNSDLYREDKDEKLKSKYTLFNDKDFKDRDYHKKYPTIHHLIMDLIEDEGKKDIRLLYLACHYLLKNRGHFIFEGQKFDTKNSFDKSINDLKIHLRDEYNIDLEFNNEDLIEIITDTTLNKTNKKKELKNIVGDTKFLKAISAIMIGSSQKLVDLFEDGEFEETTVKSVDFSTTAFDDKYSEYEEALGDTISLLNILKSIYDSSILENLLKDADKSKDGNKYISKAFVKKFNKHGKDLKTLKRIIKKYLPSEYANIFRNKSINDNYVAYTKSNITSNKRTKASKFTKQEDFYKFIKKHLDTIKETKLNSSENEDLKLIDEMLTDIEFKTFIPKLKSSDNGVIPYQLKLMELKKILDNQSKYYDFLNESDEYGTVKDKVESIMEFRIPYYVGPLNPDSKYAWIKRENTKITPWNFKDIVDLDSSREEFIDRLIGRCTYLKEEKVLPKASLIYNEFMVLNELNNLKLNEFLITEEMKKAIFEELFKTKKKVTLKAVSNLLKKEFNLTGDILLSGTDGDFKQGLNSYIDFKNIIGDKVDRDDYRIKIEEIIKLIVLYEDDKTYLKKKIKSAYKNDFTDDEIKKIAALNYKDWGRLSKRFLTGIEGVDKTTGEKGSIIYFMREYNLNLMELMSGHYTFTEEVEKLNPVENRELCYEMVDELYLSPSVKRMLWQSLRVVDEIKRIIGKDPKKIFIEMARAKEAKNSRKESRKNKLLEFYKFGKKAFINEIGEERYNYLLNEINSEEESKFRWDNLYLYYTQLGRCMYSLEPIDLADLKSNNIYDQDHIYPKSKIYDDSLENRVLVKKNLNHEKGNQYPIPEKVLNKNAYGFWKILFDKGLIGQKKYTRLTRRTPFEERELAEFIERQIVETRQATKETANLLKNICQDSEIVYSKAENASRFRQEFDIIKCRTVNDLHHMHDAYLNIVVGNVYNTKFTKNPLNFIKDKDNVRSYNLENMFKYDVVRGSYTAWIADDSEGNVKAATIKKVKRELEGKNYRFTRMSYIGTGGLYDQNLMRKGKGQIPQKENTNKSNIEKYGGYNKASSAYFALIESDGKAGRERTLETIPIMVYNQEKYGNTEAVDKYLKDNLELQDPKILKDKIKINSLIKLDGFLYNIKGKTGDSLSIAGSVQLIVNKEEQKLIKKMDKFLVKKKDNKDIKVTSFDNIKEEELIKLYKTLSDKLNNGIYSNKRNNQAKNISEALDKFKEISIEEKIDVLNQIILLFQSYNNGCNLKSIGLSAKTGVVFIPKKLNYKECKLINQSITGLFENEVDLLNL

SEQ ID NO: 319 - protein, 1358 aa, Acidaminococcus sp. D21
MGKMYYLGLDIGTNSVGYAVTDPSYHLLKFKGEPMWGAHVFAAGNQSAERRSFRTSRRRLDRRQQRVKLVQEIFAPVISPIDPRFFIRLHESALWRDDVAETDKHIFFNDPTYTDKEYYSDYPTIHHLIVDLMESSEKHDPRLVYLAVAWLVAHRGHFLNEVDKDNIGDVLSFDAFYPEFLAFLSDNGVSPWVCESKALQATLLSRNSVNDKYKALKSLIFGSQKPEDNFDANISEDGLIQLLAGKKVKVNKLFPQESNDASFTLNDKEDAIEEILGTLTPDECEWIAHIRRLFDWAIMKHALKDGRTISESKVKLYEQHHHDLTQLKYFVKTYLAKEYDDIFRNVDSETTKNYVAYSYHVKEVKGTLPKNKATQEEFCKYVLGKVKNIECSEADKVDFDEMIQRLTDNSFMPKQVSGENRVIPYQLYYYELKTILNKAASYLPFLTQCGKDAISNQDKLLSIMTFRIPYFVGPLRKDNSEHAWLERKAGKIYPWNFNDKVDLDKSEEAFIRRMTNTCTYYPGEDVLPLDSLIYEKFMILNEINNIRIDGYPISVDVKQQVFGLFEKKRRVTVKDIQNLLLSLGALDKHGKLTGIDTTIHSNYNTYHHFKSLMERGVLTRDDVERIVERMTYSDDTKRVRLWLNNNYGTLTADDVKHISRLRKHDFGRLSKMFLTGLKGVHKETGERASILDFMWNTNDNLMQLLSECYTFSDEITKLQEAYYAKAQLSLNDFLDSMYISNAVKRPIYRTLAVVNDIRKACGTAPKRIFIEMARDGESKKKRSVTRREQIKNLYRSIRKDFQQEVDFLEKILENKSDGQLQSDALYLYFAQLGRDMYTGDPIKLEHIKDQSFYNIDHIYPQSMVKDDSLDNKVLVQSEINGEKSSRYPLDAAIRNKMKPLWDAYYNHGLISLKKYQRLTRSTPFTDDEKWDFINRQLVETRQSTKALAILLKRKFPDTEIVYSKAGLSSDFRHEFGLVKSRNINDLHHAKDAFLAIVTGNVYHERFNRRWFMVNQPYSVKTKTLFTHSIKNGNFVAWNGEEDLGRIVKMLKQNKNTIHFTRFSFDRKEGLFDIQPLKASTGLVPRKAGLDVVKYGGYDKSTAAYYLLVRFTLEDKKTQHKLMMIPVEGLYKARIDHDKEFLTDYAQTTISEILQKDKQKVINIMFPMGTRHIKLNSMISIDGFYLSIGGKSSKGKSVLCHAMVPLIVPHKIECYIKAMESFARKFKENNKLRIVEKFDKITVEDNLNLYELFLQKLQHNPYNKFFSTQFDVLTNGRSTFTKLSPEEQVQTLLNILSIFKTCRSSGCDLKSINGSAQAARIMISADLTGLSKKYSDIRLVEQSASGLFVSKSQNLLEYL

SEQ ID NO: 320 - protein, 1356 aa, Lactobacillus farciminis
MTKKEQPYNIGLDIGTSSVGWAVTNDNYDLLNIKKKNLWGVRLFEEAQTAKETRLNRSTRRRYRRRKNRINWLNEIFSEELAKTDPSFLIRLQNSWVSKKDPDRKRDKYNLFIDGPYTDKEYYREFPTIFHLRKELILNKDKADIRLIYLALHNILKYRGNFTYEHQKFNISNLNNNLSKELIELNQQLIKYDISFPDDCDWNHISDILIGRGNATQKSSNILKDFTLDKETKKLLKEVINLILGNVAHLNTIFKTSLTKDEEKLNFSGKDIESKLDDLDSILDDDQFTVLDAANRIYSTITLNEILNGESYFSMAKVNQYENHAIDLCKLRDMWHTTKNEEAVEQSRQAYDDYINKPKYGTKELYTSLKKFLKVALPTNLAKEAEEKISKGTYLVKPRNSENGVVPYQLNKIEMEKIIDNQSQYYPFLKENKEKLLSILSFRIPYYVGPLQSAEKNPFAWMERKSNGHARPWNFDEIVDREKSSNKFIRRMTVTDSYLVGEPVLPKNSLIYQRYEVLNELNNIRITENLKTNPIGSRLTVETKQRIYNELFKKYKKVTVKKLTKWLIAQGYYKNPILIGLSQKDEFNSTLTTYLDMKKIFGSSFMEDNKNYDQIEELIEWLTIFEDKQILNEKLHSSKYSYTPDQIKKISNMRYKGWGRLSKKILMDITTETNTPQLLQLSNYSILDLMWATNNNFISIMSNDKYDFKNYIENHNLNKNEDQNISDLVNDIHVSPALKRGITQSIKIVQEIVKFMGHAPKHIFIEVTRETKKSEITTSREKRIKRLQSKLLNKANDFKPQLREYLVPNKKIQEELKKHKNDLSSERIMLYFLQNGKSLYSEESLNINKLSDYQVDHILPRTYIPDDSLENKALVLAKENQRKADDLLLNSNVIDRNLERWTYMLNNNMIGLKKFKNLTRRVITDKDKLGFIHRQLVQTSQMVKGVANILDNMYKNQGTTCIQARANLSTAFRKALSGQDDTYHFKHPELVKNRNVNDFHHAQDAYLASFLGTYRLRRFPTNEMLLMNGEYNKFYGQVKELYSKKKKLPDSRKNGFIISPLVNGTTQYDRNTGEIIWNVGFRDKILKIFNYHQCNVTRKTEIKTGQFYDQTIYSPKNPKYKKLIAQKKDMDPNIYGGFSGDNKSSITIVKIDNNKIKPVAIPIRLINDLKDKKTLQNWLEENVKHKKSIQIIKNNVPIGQIIYSKKVGLLSLNSDREVANRQQLILPPEHSALLRLLQIPDEDLDQILAFYDKNILVEILQELITKMKKFYPFYKGEREFLIANIENFNQATTSEKVNSLEELITLLHANSTSAHLIFNNIEKKAFGRKTHGLTLNNTDFIYQSVTGLYETRIHIE

SEQ ID NO: 321 - protein, 1421 aa, Streptococcus sanguinis
MTKFNKNYSIGLDIGVSSVGYAVVTEDYRVPAFKFKVLGNTEKEKIKKNLIGSTTFVSAQPAKGTRVFRVNRRRIDRRNHRITYLRDIFQKEIEKVDKNFYRRLDESFRVLGDKSEDLQIKQPFFGDKELETAYHKKYPTIYHLRKHLADADKNSPVADIREVYMAISHILKYRGHFLTLDKINPNNINMQNSWIDFIESCQEVFDLEISDESKNIADIFKSSENRQEKVKKILPYFQQELLKKDKSIFKQLLQLLFGLKTKFKDCFELEEEPDLNFSKENYDENLENFLGSLEEDFSDVFAKLKVLRDTILLSGMLTYTGATHARFSATMVERYEEHRKDLQRFKFFIKQNLSEQDYLDIFGRKTQNGFDVDKETKGYVGYITNKMVLTNPQKQKTIQQNFYDYISGKITGIEGAEYFLNKISDGTFLRKLRTSDNGAIPNQIHAYELEKIIERQGKDYPFLLENKDKLLSILTFKIPYYVGPLAKGSNSRFAWIKRATSSDILDDNDEDTRNGKIRPWNYQKLINMDETRDAFITNLIGNDIILLNEKVLPKRSLIYEEVMLQNELTRVKYKDKYGKAHFFDSELRQNIINGLFKNNSKRVNAKSLIKYLSDNHKDLNAIEIVSGVEKGKSFNSTLKTYNDLKTIFSEELLDSEIYQKELEEIIKVITVFDDKKSIKNYLTKFFGHLEILDEEKINQLSKLRYSGWGRYSAKLLLDIRDEDTGFNLLQFLRNDEENRNLTKLISDNTLSFEPKIKDIQSKSTIEDDIFDEIKKLAGSPAIKRGILNSIKIVDELVQIIGYPPHNIVIEMARENMTTEEGQKKAKTRKTKLESALKNIENSLLENGKVPHSDEQLQSEKLYLYYLQNGKDMYTLDKTGSPAPLYLDQLDQYEVDHIIPYSFLPIDSIDNKVLTHRENNQQKLNNIPDKETVANMKPFWEKLYNAKLISQTKYQRLTTSERTPDGVLTESMKAGFIERQLVETRQIIKHVARILDNRFSDTKIITLKSQLITNFRNTFHIAKIRELNDYHHAHDAYLAVVVGQTLLKVYPKLAPELIYGHHAHFNRHEENKATLRKHLYSNIMRFFNNPDSKVSKDIWDCNRDLPIIKDVIYNSQINFVKRTMIKKGAFYNQNPVGKFNKQLAANNRYPLKTKALCLDTSIYGGYGPMNSALSIIIIAERFNEKKGKIETVKEFHDIFIIDYEKFNNNPFQFLNDTSENGFLKKNNINRVLGFYRIPKYSLMQKIDGTRMLFESKSNLHKATQFKLTKTQNELFFHMKRLLTKSNLMDLKSKSAIKESQNFILKHKEEFDNISNQLSAFSQKMLGNTTSLKNLIKGYNERKIKEIDIRDETIKYFYDNFIKMFSFVKSGAPKDINDFFDNKCTVARMRPKPDKKLLNATLIHQSITGLYETRIDLSKLGED

SEQ ID NO: 322 - protein, 1338 aa, Coprococcus catus
MKQEYFLGLDMGTGSLGWAVTDSTYQVMRKHGKALWGTRLFESASTAEERRMFRTARRRLDRRNWRIQVLQEIFSEEISKVDPGFFLRMKESKYYPEDKRDAEGNCPELPYALFVDDNYTDKNYHKDYPTIYHLRKMLMETTEIPDIRLVYLVLHHMMKHRGHFLLSGDISQIKEFKSTFEQLIQNIQDEELEWHISLDDAAIQFVEHVLKDRNLTRSTKKSRLIKQLNAKSACEKAILNLLSGGTVKLSDIFNNKELDESERPKVSFADSGYDDYIGIVEAELAEQYYIIASAKAVYDWSVLVEILGNSVSISEAKIKVYQKHQADLKTLKKIVRQYMTKEDYKRVFVDTEEKLNNYSAYIGMTKKNGKKVDLKSKQCTQADFYDFLKKNVIKVIDHKEITQEIESEIEKENFLPKQVTKDNGVIPYQVHDYELKKILDNLGTRMPFIKENAEKIQQLFEFRIPYYVGPLNRVDDGKDGKFTWSVRKSDARIYPWNFTEVIDVEASAEKFIRRMTNKCTYLVGEDVLPKDSLVYSKFMVLNELNNLRLNGEKISVELKQRIYEELFCKYRKVTRKKLERYLVIEGIAKKGVEITGIDGDFKASLTAYHDFKERLTDVQLSQRAKEAIVLNVVLFGDDKKLLKQRLSKMYPNLTTGQLKGICSLSYQGWGRLSKTFLEEITVPAPGTGEVWNIMTALWQTNDNLMQLLSRNYGFTNEVEEFNTLKKETDLSYKTVDELYVSPAVKRQIWQTLKVVKEIQKVMGNAPKRVFVEMAREKQEGKRSDSRKKQLVELYRACKNEERDWITELNAQSDQQLRSDKLFLYYIQKGRCMYSGETIQLDELWDNTKYDIDHIYPQSKTMDDSLNNRVLVKKNYNAIKSDTYPLSLDIQKKMMSFWKMLQQQGFITKEKYVRLVRSDELSADELAGFIERQIVETRQSTKAVATILKEALPDTEIVYVKAGNVSNFRQTYELLKVREMNDLHHAKDAYLNIVVGNAYFVKFTKNAAWFIRNNPGRSYNLKRMFEFDIERSGEIAWKAGNKGSIVTVKKVMQKNNILVTRKAYEVKGGLFDQQIMKKGKGQVPIKGNDERLADIEKYGGYNKAAGTYFMLVKSLDKKGKEIRTIEFVPLYLKNQIEINHESAIQYLAQERGLNSPEILLSKIKIDTLFKVDGFKMWLSGRTGNQLIFKGANQLILSHQEAAILKGVVKYVNRKNENKDAKLSERDGMTEEKLLQLYDTFLDKLSNTVYSIRLSAQIKTLTEKRAKFIGLSNEDQCIVLNEILHMFQCQSGSANLKLIGGPGSAGILVMNNNITACKQISVINQSPTGIYEKEIDLIKL

SEQ ID NO: 323-325 - skipped (3 entries)

SEQ ID NO: 326 - protein, 1374 aa, Fusobacterium nucleatum
MKKQKFSDYYLGFDIGTNSVGWCVTDLDYNVLRFNKKDMWGSRLFDEAKTAAERRVQRNSRRRLKRRKWRLNLLEEIFSDEIMKIDSNFFRRLKESSLWLEDKNSKEKFTLFNDDNYKDYDFYKQYPTIFHLRDELIKNPEKKDIRLIYLALHSIFKSRGHFLFEGQNLKEIKNFETLYNNLISFLEDNGINKSIDKDNIEKLEKIICDSGKGLKDKEKEFKGIFNSDKQLVAIFKLSVGSSVSLNDLFDTDEYKKEEVEKEKISFREQIYEDDKPIYYSILGEKIELLDIAKSFYDFMVLNNILSDSNYISEAKVKLYEEHKKDLKNLKYIIRKYNKENYDKLFKDKNENNYPAYIGLNKEKDKKEVVEKSRLKIDDLIKVIKGYLPKPERIEEKDKTIFNEILNKIELKTILPKQRISDNGTLPYQIHEVELEKILENQSKYYDFLNYEENGVSTKDKLLKTFKFRIPYYVGPLNSYHKDKGGNSWIVRKEEGKILPWNFEQKVDIEKSAEEFIKRMTNKCTYLNGEDVIPKDSFLYSEYIILNELNKVQVNDEFLNEENKRKIIDELFKENKKVSEKKFKEYLLVNQIANRTVELKGIKDSFNSNYVSYIKFKDIFGEKLNLDIYKEISEKSILWKCLYGDDKKIFEKKIKNEYGDILNKDEIKKINSFKFNTWGRLSEKLLTGIEFINLETGECYSSVMEALRRTNYNLMELLSSKFTLQESIDNENKEMNEVSYRDLIEESYVSPSLKRAILQTLKIYEEIKKITGRVPKKVFIEMARGGDESMKNKKIPARQEQLKKLYDSCGNDIANFSIDIKEMKNSLSSYDNNSLRQKKLYLYYLQFGKCMYTGREIDLDRLLQNNDTYDIDHIYPRSKVIKDDSFDNLVLVLKNENAEKSNEYPVKKEIQEKMKSFWRFLKEKNFISDEKYKRLTGKDDFELRGFMARQLVNVRQTTKEVGKILQQIEPEIKIVYSKAEIASSFREMFDFIKVRELNDTHHAKDAYLNIVAGNVYNTKFTEKPYRYLQEIKENYDVKKIYNYDIKNAWDKENSLEIVKKNMEKNTVNITRFIKEEKGELFNLNPIKKGETSNEIISIKPKLYDGKDNKLNEKYGYYTSLKAAYFIYVEHEKKNKKVKTFERITRIDSTLIKNEKNLIKYLVSQKKLLNPKIIKKIYKEQTLIIDSYPYTFTGVDSNKKVELKNKKQLYLEKKYEQILKNALKFVEDNQGETEENYKFIYLKKRNNNEKNETIDAVKERYNIEFNEMYDKFLEKLSSKDYKNYINNKLYTNFLNSKEKFKKLKLWEKSLILREFLKIFNKNTYGKYEIKDSQTKEKLFSFPEDTGRIRLGQSSLGNNKELLEESVTGLFVKKIKL

SEQ ID NO: 327 - protein, 1333 aa, Planococcus antarcticus
MKNYTIGLDIGVASVGWVCIDENYKILNYNNRHAFGVHEFESAESAAGRRLKRGMRRRYNRRKKRLQLLQSLFDSYITDSGFFSKTDSQHFWKNNNEFENRSLTEVLSSLRISSRKYPTIYHLRSDLIESNKKMDLRLVYLALHNLVKYRGHFLQEGNWSEAASAEGMDDQLLELVTRYAELENLSPLDLSESQWKAAETLLLNRNLTKTDQSKELTAMFGKEYEPFCKLVAGLGVSLHQLFPSSEQALAYKETKTKVQLSNENVEEVMELLLEEESALLEAVQPFYQQVVLYELLKGETYVAKAKVSAFKQYQKDMASLKNLLDKTFGEKVYRSYFISDKNSQREYQKSHKVEVLCKLDQFNKEAKFAETFYKDLKKLLEDKSKTSIGTTEKDEMLRIIKAIDSNQFLQKQKGIQNAAIPHQNSLYEAEKILRNQQAHYPFITTEWIEKVKQILAFRIPYYIGPLVKDTTQSPFSWVERKGDAPITPWNFDEQIDKAASAEAFISRMRKTCTYLKGQEVLPKSSLTYERFEVLNELNGIQLRTTGAESDFRHRLSYEMKCWIIDNVFKQYKTVSTKRLLQELKKSPYADELYDEHTGEIKEVFGTQKENAFATSLSGYISMKSILGAVVDDNPAMTEELIYWIAVFEDREILHLKIQEKYPSITDVQRQKLALVKLPGWGRFSRLLIDGLPLDEQGQSVLDHMEQYSSVFMEVLKNKGFGLEKKIQKMNQHQVDGTKKIRYEDIEELAGSPALKRGIWRSVKIVEELVSIFGEPANIVLEVAREDGEKKRTKSRKDQWEELTKTTLKNDPDLKSFIGEIKSQGDQRFNEQRFWLYVTQQGKCLYTGKALDIQNLSMYEVDHILPQNFVKDDSLDNLALVMPEANQRKNQVGQNKMPLEIIEANQQYAMRTLWERLHELKLISSGKLGRLKKPSFDEVDKDKFIARQLVETRQIIKHVRDLLDERFSKSDIHLVKAGIVSKFRRFSEIPKIRDYNNKHHAMDALFAAALIQSILGKYGKNFLAFDLSKKDRQKQWRSVKGSNKEFFLFKNFGNLRLQSPVTGEEVSGVEYMKHVYFELPWQTTKMTQTGDGMFYKESIFSPKVKQAKYVSPKTEKFVHDEVKNHSICLVEFTFMKKEKEVQETKFIDLKVIEHHQFLKEPESQLAKFLAEKETNSPIIHARIIRTIPKYQKIWIEHFPYYFISTRELHNARQFEISYELMEKVKQLSERSSVEELKIVFGLLIDQMNDNYPIYTKSSIQDRVQKFVDTQLYDFKSFEIGFEELKKAVAANAQRSDTFGSRISKKPKPEEVAIGYESITGLKYRKPRSVVGTKR

SEQ ID NO: 328 - protein, 1395 aa, Treponema denticola
MKKEIKDYFLGLDVGTGSVGWAVTDTDYKLLKANRKDLWGMRCFETAETAEVRRLHRGARRRIERRKKRIKLLQELFSQEIAKTDEGFFQRMKESPFYAEDKTILQENTLFNDKDFADKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSGYVGVCKTKSKKLIINNSVNQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKFFPDRCWVVKKEKSPSGKTTPWNFFDHIDKEKTAEAFITSRTNFCTYLVGESVLPKSSLLYSEYTVLNEINNLQIIIDGKNICDIKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFTFTENIKKINSGFEDAEKQFSYDGLVKPLFLSPSVKKMLWQTLKLVKEISHITQAPPKKIFIEMAKGAELEPARTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRATPISDDETAKFIARQLVETRQATKVAAKVLEKMFPETKIVYSKAETVSMFRNKFDIVKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPFSNISKYGGYNKVSAAYYTLIEYEEKGNKIRSLETIPLYLVKDIQKDQDVLKSYLTDLLGKKEFKILVPKIKINSLLKINGFPCHITGKTNDSFLLRPAVQFCCSNNEVLYFKKIIRFSEIRSQREKIGKTISPYEDLSFRSYIKENLWKKTKNDEIGEKEFYDLLQKKNLEIYDMLLTKHKDTIYKKRPNSATIDILVKGKEKFKSLIIENQFEVILEILKLFSATRNVSDLQHIGGSKYSGVAKIGNKISSLDNCILIYQSITGIFEKRIDLLKV

SEQ ID NO: 329 - protein, 1327 aa, Solobacterium moorei
MEGQMKNNGNNLQQGNYYLGLDVGTSSVGWAVTDTDYNVLKFRGKSMWGARLFDEASTAEERRTHRGNRRRLARRKYRLLLLEQLFEKEIRKIDDNFFVRLHESNLWADDKSKPSKFLLFNDTNFTDKDYLKKYPTIYHLRSDLIHNSTEHDIRLVFLALHHLIKYRGHFIYDNSANGDVKTLDEAVSDFEEYLNENDIEFNIENKKEFINVLSDKHLTKKEKKISLKKLYGDITDSENINISVLIEMLSGSSISLSNLFKDIEFDGKQNLSLDSDIEETLNDVVDILGDNIDLLIHAKEVYDIAVLTSSLGKHKYLCDAKVELFEKNKKDLMILKKYIKKNHPEDYKKIFSSPTEKKNYAAYSQTNSKNVCSQEEFCLFIKPYIRDMVKSENEDEVRIAKEVEDKSFLTKLKGTNNSVVPYQIHERELNQILKNIVAYLPFMNDEQEDISVVDKIKLIFKFKIPYYVGPLNTKSTRSWVYRSDEKIYPWNFSNVIDLDKTAHEFMNRLIGRCTYTNDPVLPMDSLLYSKYNVLNEINPIKVNGKAIPVEVKQAIYTDLFENSKKKVTRKSIYIYLLKNGYIEKEDIVSGIDIEIKSKLKSHHDFTQIVQENKCTPEEIERIIKGILVYSDDKSMLRRWLKNNIKGLSENDVKYLAKLNYKEWGRLSKTLLTDIYTINPEDGEACSILDIMWNTNATLMEILSNEKYQFKQNIENYKAENYDEKQNLHEELDDMYISPAARRSIWQALRIVDEIVDIKKSAPKKIFIEMAREKKSAMKKKRTESRKDTLLELYKSCKSQADGFYDEELFEKLSNESNSRLRRDQLYLYYTQMGRSMYTGKRIDFDKLINDKNTYDIDHIYPRSKIKDDSITNRVLVEKDINGEKTDIYPISEDIRQKMQPFWKILKEKGLINEEKYKRLTRNYELTDEELSSFVARQLVETQQSTKALATLLKKEYPSAKIVYSKAGNVSEFRNRKDKELPKFREINDLHHAKDAYLNIVVGNVYDTKFTEKFFNNIRNENYSLKRVFDFSVPGAWDAKGSTFNTIKKYMAKNNPIIAFAPYEVKGELFDQQIVPKGKGQFPIKQGKDIEKYGGYNKLSSAFLFAVEYKGKKARERSLETVYIKDVELYLQDPIKYCESVLGLKEPQIIKPKILMGSLFSINNKKLVVTGRSGKQYVCHHIYQLSINDEDSQYLKNIAKYLQEEPDGNIERQNILNITSVNNIKLFDVLCTKFNSNTYEIILNSLKNDVNEGREKFSELDILEQCNILLQLLKAFKCNRESSNLEKLNNKKQAGVIVIPHLFTKCSVFKVIHQSITGLFEKEMDLLK

SEQ ID NO: 330 - protein, 1334 aa, Staphylococcus pseudintermedius
MGRKPYILSLDIGTGSVGYACMDKGFNVLKYHDKDALGVYLFDGALTAQERRQFRTSRRRKNRRIKRLGLLQELLAPLVQNPNFYQFQRQFAWKNDNMDFKNKSLSEVLSFLGYESKKYPTIYHLQEALLLKDEKFDPELIYMALYHLVKYRGHFLFDHLKIENLTNNDNMHDFVELIETYENLNNIKLNLDYEKTKVIYEILKDNEMTKNDRAKRVKNMEKKLEQFSIMLLGLKFNEGKLFNHADNAEELKGANQSHTFADNYEENLTPFLTVEQSEFIERANKIYLSLTLQDILKGKKSMAMSKVAAYDKFRNELKQVKDIVYKADSTRTQFKKIFVSSKKSLKQYDATPNDQTFSSLCLFDQYLIRPKKQYSLLIKELKKIIPQDSELYFEAENDTLLKVLNTTDNASIPMQINLYEAETILRNQQKYHAEITDEMIEKVLSLIQFRIPYYVGPLVNDHTASKFGWMERKSNESIKPWNFDEVVDRSKSATQFIRRMTNKCSYLINEDVLPKNSLLYQEMEVLNELNATQIRLQTDPKNRKYRMMPQIKLFAVEHIFKKYKTVSHSKFLEIMLNSNHRENFMNHGEKLSIFGTQDDKKFASKLSSYQDMTKIFGDIEGKRAQIEEIIQWITIFEDKKILVQKLKECYPELTSKQINQLKKLNYSGWGRLSEKLLTHAYQGHSIIELLRHSDENFMEILTNDVYGFQNFIKEENQVQSNKIQHQDIANLTTSPALKKGIWSTIKLVRELTSIFGEPEKIIMEFATEDQQKGKKQKSRKQLWDDNIKKNKLKSVDEYKYIIDVANKLNNEQLQQEKLWLYLSQNGKCMYSGQSIDLDALLSPNATKHYEVDHIFPRSFIKDDSIDNKVLVIKKMNQTKGDQVPLQFIQQPYERIAYWKSLNKAGLISDSKLHKLMKPEFTAMDKEGFIQRQLVETRQISVHVRDFLKEEYPNTKVIPMKAKMVSEFRKKFDIPKIRQMNDAHHAIDAYLNGVVYHGAQLAYPNVDLFDFNFKWEKVREKWKALGEFNTKQKSRELFFFKKLEKMEVSQGERLISKIKLDMNHFKINYSRKLANIPQQFYNQTAVSPKTAELKYESNKSNEVVYKGLTPYQTYVVAIKSVNKKGKEKMEYQMIDHYVFDFYKFQNGNEKELALYLAQRENKDEVLDAQIVYSLNKGDLLYINNHPCYFVSRKEVINAKQFELTVEQQLSLYNVMNNKETNVEKLLIEYDFIAEKVINEYHHYLNSKLKEKRVRTFFSESNQTHEDFIKALDELFKVVTASATRSDKIGSRKNSMTHRAFLGKGKDVKIAYTSISGLKTTKPKSLFKLAESRNEL

SEQ ID NO: 331 - protein, 1472 aa, Flavobacterium branchiophilum
MAKILGLDLGTNSIGWAVVERENIDFSLIDKGVRIFSEGVKSEKGIESSRAAERTGYRSARKIKYRRKLRKYETLKVLSLNRMCPLSIEEVEEWKKSGFKDYPLNPEFLKWLSTDEESNVNPYFFRDRASKHKVSLFELGRAFYHIAQRRGFLSNRLDQSAEGILEEHCPKIEAIVEDLISIDEISTNITDYFFETGILDSNEKNGYAKDLDEGDKKLVSLYKSLLAILKKNESDFENCKSEIIERLNKKDVLGKVKGKIKDISQAMLDGNYKTLGQYFYSLYSKEKIRNQYTSREEHYLSEFITICKVQGIDQINEEEKINEKKFDGLAKDLYKAIFFQRPLKSQKGLIGKCSFEKSKSRCAISHPDFEEYRMWTYLNTIKIGTQSDKKLRFLTQDEKLKLVPKFYRKNDFNFDVLAKELIEKGSSFGFYKSSKKNDFFYWFNYKPTDTVAACQVAASLKNAIGEDWKTKSFKYQTINSNKEQVSRTVDYKDLWHLLTVATSDVYLYEFAIDKLGLDEKNAKAFSKTKLKKDFASLSLSAINKILPYLKEGLLYSHAVFVANIENIVDENIWKDEKQRDYIKTQISEIIENYTLEKSRFEIINGLLKEYKSENEDGKRVYYSKEAEQSFENDLKKKLVLFYKSNEIENKEQQETIFNELLPIFIQQLKDYEFIKIQRLDQKVLIFLKGKNETGQIFCTEEKGTAEEKEKKIKNRLKKLYHPSDIEKFKKKIIKDEFGNEKIVLGSPLTPSIKNPMAMRALHQLRKVLNALILEGQIDEKTIIHIEMARELNDANKRKGIQDYQNDNKKFREDAIKEIKKLYFEDCKKEVEPTEDDILRYQLWMEQNRSEIYEEGKNISICDIIGSNPAYDIEHTIPRSRSQDNSQMNKTLCSQRFNREVKKQSMPIELNNHLEILPRIAHWKEEADNLTREIEIISRSIKAAATKEIKDKKIRRRHYLTLKRDYLQGKYDRFIWEEPKVGFKNSQIPDTGIITKYAQAYLKSYFKKVESVKGGMVAEFRKIWGIQESFIDENGMKHYKVKDRSKHTHHTIDAITIACMTKEKYDVLAHAWTLEDQQNKKEARSIIEASKPWKTFKEDLLKIEEEILVSHYTPDNVKKQAKKIVRVRGKKQFVAEVERDVNGKAVPKKAASGKTIYKLDGEGKKLPRLQQGDTIRGSLHQDSIYGAIKNPLNTDEIKYVIRKDLESIKGSDVESIVDEVVKEKIKEAIANKVLLLSSNAQQKNKLVGTVWMNEEKRIAINKVRIYANSVKNPLHIKEHSLLSKSKHVHKQKVYGQNDENYAMAIYELDGKRDFELINIFNLAKLIKQGQGFYPLHKKKEIKGKIVFVPIEKRNKRDVVLKRGQQVVFYDKEVENPKDISEIVDFKGRIYIIEGLSIQRIVRPSGKVDEYGVIMLRYFKEARKADDIKQDNFKPDGVFKLGENKPTRKMNHQFTAFVEGIDFKVLPSGKFEKI

SEQ ID NO: 332 - protein, 1688 aa, Ignavibacterium album
MEFKKVLGLDIGTNSIGCALLSLPKSIQDYGKGGRLEWLTSRVIPLDADYMKAFIDGKNGLPQVITPAGKRRQKRGSRRLKHRYKLRRSRLIRVFKTLNWLPEDFPLDNPKRIKETISTEGKFSFRISDYVPISDESYREFYREFGYPENEIEQVIEEINFRRKTKGKNKNPMIKLLPEDWVVYYLRKKALIKPTTKEELIRIIYLFNQRRGFKSSRKDLTETAILDYDEFAKRLAEKEKYSAENYETKFVSITKVKEVVELKTDGRKGKKRFKVILEDSRIEPYEIERKEKPDWEGKEYTFLVTQKLEKGKFKQNKPDLPKEEDWALCTTALDNRMGSKHPGEFFFDELLKAFKEKRGYKIRQYPVNRWRYKKELEFIWTKQCQLNPELNNLNINKEILRKLATVLYPSQSKFFGPKIKEFENSDVLHIISEDIIYYQRDLKSQKSLISECRYEKRKGIDGEIYGLKCIPKSSPLYQEFRIWQDIHNIKVIRKESEVNGKKKINIDETQLYINENIKEKLFELFNSKDSLSEKDILELISLNIINSGIKISKKEEETTHRINLFANRKELKGNETKSRYRKVFKKLGFDGEYILNHPSKLNRLWHSDYSNDYADKEKTEKSILSSLGWKNRNGKWEKSKNYDVFNLPLEVAKAIANLPPLKKEYGSYSALAIRKMLVVMRDGKYWQHPDQIAKDQENTSLMLFDKNLIQLTNNQRKVLNKYLLTLAEVQKRSTLIKQKLNEIEHNPYKLELVSDQDLEKQVLKSFLEKKNESDYLKGLKTYQAGYLIYGKHSEKDVPIVNSPDELGEYIRKKLPNNSLRNPIVEQVIRETIFIVRDVWKSFGIIDEIHIELGRELKNNSEERKKTSESQEKNFQEKERARKLLKELLNSSNFEHYDENGNKIFSSFTVNPNPDSPLDIEKFRIWKNQSGLTDEELNKKLKDEKIPTEIEVKKYILWLTQKCRSPYTGKIIPLSKLFDSNVYEIEHIIPRSKMKNDSTNNLVICELGVNKAKGDRLAANFISESNGKCKFGEVEYTLLKYGDYLQYCKDTFKYQKAKYKNLLATEPPEDFIERQINDTRYIGRKLAELLTPVVKDSKNIIFTIGSITSELKITWGLNGVWKDILRPRFKRLESIINKKLIFQDEDDPNKYHFDLSINPQLDKEGLKRLDHRHHALDATIIAATTREHVRYLNSLNAADNDEEKREYFLSLCNHKIRDFKLPWENFTSEVKSKLLSCVVSYKESKPILSDPFNKYLKWEYKNGKWQKVFAIQIKNDRWKAVRRSMFKEPIGTVWIKKIKEVSLKEAIKIQAIWEEVKNDPVRKKKEKYIYDDYAQKVIAKIVQELGLSSSMRKQDDEKLNKFINEAKVSAGVNKNLNTTNKTIYNLEGRFYEKIKVAEYVLYKAKRMPLNKKEYIEKLSLQKMFNDLPNFILEKSILDNYPEILKELESDNKYIIEPHKKNNPVNRLLLEHILEYHNNPKEAFSTEGLEKLNKKAINKIGKPIKYITRLDGDINEEEIFRGAVFETDKGSNVYFVMYENNQTKDREFLKPNPSISVLKAIEHKNKIDFFAPNRLGFSRIILSPGDLVYVPTNDQYVLIKDNSSNETIINWDDNEFISNRIYQVKKFTGNSCYFLKNDIASLILSYSASNGVGEFGSQNISEYSVDDPPIRIKDVCIKIRVDRLGNVRPL

SEQ ID NO: 333 - protein, 1415 aa, Bergeyella zoohelcum
MKHILGLDLGTNSIGWALIERNIEEKYGKIIGMGSRIVPMGAELSKFEQGQAQTKNADRRTNRGARRLNKRYKQRRNKLIYILQKLDMLPSQIKLKEDFSDPNKIDKITILPISKKQEQLTAFDLVSLRVKALTEKVGLEDLGKIIYKYNQLRGYAGGSLEPEKEDIFDEEQSKDKKNKSFIAFSKIVFLGEPQEEIFKNKKLNRRAIIVETEEGNFEGSTFLENIKVGDSLELLINISASKSGDTITIKLPNKTNWRKKMENIENQLKEKSKEMGREFYISEFLLELLKENRWAKIRNNTILRARYESEFEAIWNEQVKHYPFLENLDKKTLIEIVSFIFPGEKESQKKYRELGLEKGLKYIIKNQVVFYQRELKDQSHLISDCRYEPNEKAIAKSHPVFQEYKVWEQINKLIVNTKIEAGTNRKGEKKYKYIDRPIPTALKEWIFEELQNKKEITFSAIFKKLKAEFDLREGIDFLNGMSPKDKLKGNETKLQLQKSLGELWDVLGLDSINRQIELWNILYNEKGNEYDLTSDRTSKVLEFINKYGNNIVDDNAEETAIRISKIKFARAYSSLSLKAVERILPLVRAGKYFNNDFSQQLQSKILKLLNENVEDPFAKAAQTYLDNNQSVLSEGGVGNSIATILVYDKHTAKEYSHDELYKSYKEINLLKQGDLRNPLVEQIINEALVLIRDIWKNYGIKPNEIRVELARDLKNSAKERATIHKRNKDNQTINNKIKETLVKNKKELSLANIEKVKLWEAQRHLSPYTGQPIPLSDLFDKEKYDVDHIIPISRYFDDSFTNKVISEKSVNQEKANRTAMEYFEVGSLKYSIFTKEQFIAHVNEYFSGVKRKNLLATSIPEDPVQRQIKDTQYIAIRVKEELNKIVGNENVKTTTGSITDYLRNHWGLTDKFKLLLKERYEALLESEKFLEAEYDNYKKDFDSRKKEYEEKEVLFEEQELTREEFIKEYKENYIRYKKNKLIIKGWSKRIDHRHHAIDALIVACTEPAHIKRLNDLNKVLQDWLVEHKSEFMPNFEGSNSELLEEILSLPENERTEIFTQIEKFRAIEMPWKGFPEQVEQKLKEIIISHKPKDKLLLQYNKAGDRQIKLRGQLHEGTLYGISQGKEAYRIPLTKFGGSKFATEKNIQKIVSPFLSGFIANHLKEYNNKKEEAFSAEGIMDLNNKLAQYRNEKGELKPHTPISTVKIYYKDPSKNKKKKDEEDLSLQKLDREKAFNEKLYVKTGDNYLFAVLEGEIKTKKTSQIKRLYDIISFFDATNFLKEEFRNAPDKKTFDKDLLFRQYFEERNKAKLLFTLKQGDFVYLPNENEEVILDKESPLYNQYWGDLKERGKNIYVVQKFSKKQIYFIKHTIADIIKKDVEFGSQNCYETVEGRSIKENCFKLEIDRLGNIVKVIKR

SEQ ID NO: 334 - protein, 1166 aa, Nitrobacter hamburgensis
MHVEIDFPHFSRGDSHLAMNKNEILRGSSVLYRLGLDLGSNSLGWFVTHLEKRGDRHEPVALGPGGVRIFPDGRDPQSGTSNAVDRRMARGARKRRDRFVERRKELIAALIKYNLLPDDARERRALEVLDPYALRKTALTDTLPAHHVGRALFHLNQRRGFQSNRKTDSKQSEDGAIKQAASRLATDKGNETLGVFFADMHLRKSYEDRQTAIRAELVRLGKDHLTGNARKKIWAKVRKRLFGDEVLPRADAPHGVRARATITGTKASYDYYPTRDMLRDEFNAIWAGQSAHHATITDEARTEIEHIIFYQRPLKPAIVGKCTLDPATRPFKEDPEGYRAPWSHPLAQRFRILSEARNLEIRDTGKGSRRLTKEQSDLVVAALLANREVKFDKLRTLLKLPAEARFNLESDRRAALDGDQTAARLSDKKGFNKAWRGFPPERQIAIVARLEETEDENELIAWLEKECALDGAAAARVANTTLPDGHCRLGLRAIKKIVPIMQDGLDEDGVAGAGYHIAAKRAGYDHAKLPTGEQLGRLPYYGQWLQDAVVGSGDARDQKEKQYGQFPNPTVHIGLGQLRRVVNDLIDKYGPPTEISIEFTRALKLSEQQKAERQREQRRNQDKNKARAEELAKFGRPANPRNLLKMRLWEELAHDPLDRKCVYTGEQISIERLLSDEVDIDHILPVAMTLDDSPANKIICMRYANRHKRKQTPSEAFGSSPTLQGHRYNWDDIAARATGLPRNKRWRFDANAREEFDKRGGFLARQLNETGWLARLAKQYLGAVTDPNQIWVVPGRLTSMLRGKWGLNGLLPSDNYAGVQDKAEEFLASTDDMEFSGVKNRADHRHHAIDGLVTALTDRSLLWKMANAYDEEHEKFVIEPPWPTMRDDLKAALEKMVVSHKPDHGIEGKLHEDSAYGFVKPLDATGLKEEEAGNLVYRKAIESLNENEVDRIRDIQLRTIVRDHVNVEKTKGVALADALRQLQAPSDDYPQFKHGLRHVRILKKEKGDYLVPIANRASGVAYKAYSAGENFCVEVFETAGGKWDGEAVRRFDANKKNAGPKIAHAPQWRDANEGAKLVMRIHKGDLIRLDHEGRARIMVVHRLDAAAGRFKLADHNETGNLDKRHATNNDIDPFRWLMASYNTLKKLAAVPVRVDELGRVWRVMPN

SEQ ID NO: 335 - protein, 1498 aa, Odoribacter laneus
METTLGIDLGTNSIGLALVDQEEHQILYSGVRIFPEGINKDTIGLGEKEESRNATRRAKRQMRRQYFRKKLRKAKLLELLIAYDMCPLKPEDVRRWKNWDKQQKSTVRQFPDTPAFREWLKQNPYELRKQAVTEDVTRPELGRILYQMIQRRGFLSSRKGKEEGKIFTGKDRMVGIDETRKNLQKQTLGAYLYDIAPKNGEKYRFRTERVRARYTLRDMYIREFEIIWQRQAGHLGLAHEQATRKKNIFLEGSATNVRNSKLITHLQAKYGRGHVLIEDTRITVTFQLPLKEVLGGKIEIEEEQLKFKSNESVLFWQRPLRSQKSLLSKCVFEGRNFYDPVHQKWIIAGPTPAPLSHPEFEEFRAYQFINNIIYGKNEHLTAIQREAVFELMCTESKDFNFEKIPKHLKLFEKFNFDDTTKVPACTTISQLRKLFPHPVWEEKREEIWHCFYFYDDNTLLFEKLQKDYALQTNDLEKIKKIRLSESYGNVSLKAIRRINPYLKKGYAYSTAVLLGGIRNSFGKRFEYFKEYEPEIEKAVCRILKEKNAEGEVIRKIKDYLVHNRFGFAKNDRAFQKLYHHSQAITTQAQKERLPETGNLRNPIVQQGLNELRRTVNKLLATCREKYGPSFKFDHIHVEMGRELRSSKTEREKQSRQIRENEKKNEAAKVKLAEYGLKAYRDNIQKYLLYKEIEEKGGTVCCPYTGKTLNISHTLGSDNSVQIEHIIPYSISLDDSLANKTLCDATFNREKGELTPYDFYQKDPSPEKWGASSWEEIEDRAFRLLPYAKAQRFIRRKPQESNEFISRQLNDTRYISKKAVEYLSAICSDVKAFPGQLTAELRHLWGLNNILQSAPDITFPLPVSATENHREYYVITNEQNEVIRLFPKQGETPRTEKGELLLTGEVERKVFRCKGMQEFQTDVSDGKYWRRIKLSSSVTWSPLFAPKPISADGQIVLKGRIEKGVFVCNQLKQKLKTGLPDGSYWISLPVISQTFKEGESVNNSKLTSQQVQLFGRVREGIFRCHNYQCPASGADGNFWCTLDTDTAQPAFTPIKNAPPGVGGGQIILTGDVDDKGIFHADDDLHYELPASLPKGKYYGIFTVESCDPTLIPIELSAPKTSKGENLIEGNIWVDEHTGEVRFDPKKNREDQRHHAIDAIVIALSSQSLFQRLSTYNARRENKKRGLDSTEHFPSPWPGFAQDVRQSVVPLLVSYKQNPKTLCKISKTLYKDGKKIHSCGNAVRGQLHKETVYGQRTAPGATEKSYHIRKDIRELKTSKHIGKVVDITIRQMLLKHLQENYHIDITQEFNIPSNAFFKEGVYRIFLPNKHGEPVPIKKIRMKEELGNAERLKDNINQYVNPRNNHHVMIYQDADGNLKEEIVSFWSVIERQNQGQPIYQLPREGRNIVSILQINDTFLIGLKEEEPEVYRNDLSTLSKHLYRVQKLSGMYYTFRHHLASTLNNEREEFRIQSLEAWKRANPVKVQIDEIGRITFLNGPLC

SEQ ID NO: 336 - protein, 1372 aa, Legionella pneumophila
MESSQILSPIGIDLGGKFTGVCLSHLEAFAELPNHANTKYSVILIDHNNFQLSQAQRRATRHRVRNKKRNQFVKRVALQLFQHILSRDLNAKEETALCHYLNNRGYTYVDTDLDEYIKDETTINLLKELLPSESEHNFIDWFLQKMQSSEFRKILVSKVEEKKDDKELKNAVKNIKNFITGFEKNSVEGHRHRKVYFENIKSDITKDNQLDSIKKKIPSVCLSNLLGHLSNLQWKNLHRYLAKNPKQFDEQTFGNEFLRMLKNFRHLKGSQESLAVRNLIQQLEQSQDYISILEKTPPEITIPPYEARTNTGMEKDQSLLLNPEKLNNLYPNWRNLIPGIIDAHPFLEKDLEHTKLRDRKRIISPSKQDEKRDSYILQRYLDLNKKIDKFKIKKQLSFLGQGKQLPANLIETQKEMETHFNSSLVSVLIQIASAYNKEREDAAQGIWFDNAFSLCELSNINPPRKQKILPLLVGAILSEDFINNKDKWAKFKIFWNTHKIGRTSLKSKCKEIEEARKNSGNAFKIDYEEALNHPEHSNNKALIKIIQTIPDIIQAIQSHLGHNDSQALIYHNPFSLSQLYTILETKRDGFHKNCVAVTCENYWRSQKTEIDPEISYASRLPADSVRPFDGVLARMMQRLAYEIAMAKWEQIKHIPDNSSLLIPIYLEQNRFEFEESFKKIKGSSSDKTLEQAIEKQNIQWEEKFQRIINASMNICPYKGASIGGQGEIDHIYPRSLSKKHFGVIFNSEVNLIYCSSQGNREKKEEHYLLEHLSPLYLKHQFGTDNVSDIKNFISQNVANIKKYISFHLLTPEQQKAARHALFLDYDDEAFKTITKFLMSQQKARVNGTQKFLGKQIMEFLSTLADSKQLQLEFSIKQITAEEVHDHRELLSKQEPKLVKSRQQSFPSHAIDATLTMSIGLKEFPQFSQELDNSWFINHLMPDEVHLNPVRSKEKYNKPNISSTPLFKDSLYAERFIPVWVKGETFAIGFSEKDLFEIKPSNKEKLFTLLKTYSTKNPGESLQELQAKSKAKWLYFPINKTLALEFLHHYFHKEIVTPDDTTVCHFINSLRYYTKKESITVKILKEPMPVLSVKFESSKKNVLGSFKHTIALPATKDWERLFNHPNFLALKANPAPNPKEFNEFIRKYFLSDNNPNSDIPNNGHNIKPQKHKAVRKVFSLPVIPGNAGTMMRIRRKDNKGQPLYQLQTIDDTPSMGIQINEDRLVKQEVLMDAYKTRNLSTIDGINNSEGQAYATFDNWLTLPVSTFKPEIIKLEMKPHSKTRRYIRITQSLADFIKTIDEALMIKPSDSIDDPLNMPNEIVCKNKLFGNELKPRDGKMKIVSTGKIVTYEFESDSTPQWIQTLYVTQLKKQP

SEQ ID NO: 337 - protein, 1517 aa, Bacteroides sp. 20_3
MKKIVGLDLGTNSIGWALINAYINKEHLYGIEACGSRIIPMDAAILGNFDKGNSISQTADRTSYRGIRRLRERHLLRRERLHRILDLLGFLPKHYSDSLNRYGKFLNDIECKLPWVKDETGSYKFIFQESFKEMLANFTEHHPILIANNKKVPYDWTIYYLRKKALTQKISKEELAWILLNFNQKRGYYQLRGEEEETPNKLVEYYSLKVEKVEDSGERKGKDTWYNVHLENGMIYRRTSNIPLDWEGKTKEFIVTTDLEADGSPKKDKEGNIKRSFRAPKDDDWTLIKKKTEADIDKIKMTVGAYIYDTLLQKPDQKIRGKLVRTIERKYYKNELYQILKTQSEFHEELRDKQLYIACLNELYPNNEPRRNSISTRDFCHLFIEDIIFYQRPLKSKKSLIDNCPYEENRYIDKESGEIKHASIKCIAKSHPLYQEFRLWQFIVNLRIYRKETDVDVTQELLPTEADYVTLFEWLNEKKEIDQKAFFKYPPFGFKKTTSNYRWNYVEDKPYPCNETHAQIIARLGKAHIPKAFLSKEKEETLWHILYSIEDKQEIEKALHSFANKNNLSEEFIEQFKNFPPFKKEYGSYSAKAIKKLLPLMRMGKYWSIENIDNGTRIRINKIIDGEYDENIRERVRQKAINLTDITHFRALPLWLACYLVYDRHSEVKDIVKWKTPKDIDLYLKSFKQHSLRNPIVEQVITETLRTVRDIWQQVGHIDEIHIELGREMKNPADKRARMSQQMIKNENTNLRIKALLTEFLNPEFGIENVRPYSPSQQDLLRIYEEGVLNSILELPEDIGIILGKFNQTDTLKRPTRSEILRYKLWLEQKYRSPYTGEMIPLSKLFTPAYEIEHIIPQSRYFDDSLSNKVICESEINKLKDRSLGYEFIKNHHGEKVELAFDKPVEVLSVEAYEKLVHESYSHNRSKMKKLLMEDIPDQFIERQLNDSRYISKVVKSLLSNIVREENEQEAISKNVIPCTGGITDRLKKDWGINDVWNKIVLPRFIRLNELTESTRFTSINTNNTMIPSMPLELQKGFNKKRIDHRHHAMDAIIIACANRNIVNYLNNVSASKNTKITRRDLQTLLCHKDKTDNNGNYKWVIDKPWETFTQDTLTALQKITVSFKQNLRVINKTTNHYQHYENGKKIVSNQSKGDSWAIRKSMHKETVHGEVNLRMIKTVSFNEALKKPQAIVEMDLKKKILAMLELGYDTKRIKNYFEENKDTWQDINPSKIKVYYFTKETKDRYFAVRKPIDTSFDKKKIKESITDTGIQQIMLRHLETKDNDPTLAFSPDGIDEMNRNILILNKGKKHQPIYKVRVYEKAEKFTVGQKGNKRTKFVEAAKGTNLFFAIYETEEIDKDTKKVIRKRSYSTIPLNVVIERQKQGLSSAPEDENGNLPKYILSPNDLVYVPTQEEINKGEVVMPIDRDRIYKMVDSSGITANFIPASTANLIFALPKATAEIYCNGENCIQNEYGIGSPQSKNQKAITGEMVKEICFPIKVDRLGNIIQVGSCILTN

SEQ ID NO: 338 - protein, 1101 aa, Akkermansia muciniphila
MSRSLTFSFDIGYASIGWAVIASASHDDADPSVCGCGTVLFPKDDCQAFKRREYRRLRRNIRSRRVRIERIGRLLVQAQIITPEMKETSGHPAPFYLASEALKGHRTLAPIELWHVLRWYAHNRGYDNNASWSNSLSEDGGNGEDTERVKHAQDLMDKHGTATMAETICRELKLEEGKADAPMEVSTPAYKNLNTAFPRLIVEKEVRRILELSAPLIPGLTAEIIELIAQHHPLTTEQRGVLLQHGIKLARRYRGSLLFGQLIPRFDNRIISRCPVTWAQVYEAELKKGNSEQSARERAEKLSKVPTANCPEFYEYRMARILCNIRADGEPLSAEIRRELMNQARQEGKLTKASLEKAISSRLGKETETNVSNYFTLHPDSEEALYLNPAVEVLQRSGIGQILSPSVYRIAANRLRRGKSVTPNYLLNLLKSRGESGEALEKKIEKESKKKEADYADTPLKPKYATGRAPYARTVLKKVVEEILDGEDPTRPARGEAHPDGELKAHDGCLYCLLDTDSSVNQHQKERRLDTMTNNHLVRHRMLILDRLLKDLIQDFADGQKDRISRVCVEVGKELTTFSAMDSKKIQRELTLRQKSHTDAVNRLKRKLPGKALSANLIRKCRIAMDMNWTCPFTGATYGDHELENLELEHIVPHSFRQSNALSSLVLTWPGVNRMKGQRTGYDFVEQEQENPVPDKPNLHICSLNNYRELVEKLDDKKGHEDDRRRKKKRKALLMVRGLSHKHQSQNHEAMKEIGMTEGMMTQSSHLMKLACKSIKTSLPDAHIDMIPGAVTAEVRKAWDVFGVFKELCPEAADPDSGKILKENLRSLTHLHHALDACVLGLIPYIIPAHHNGLLRRVLAMRRIPEKLIPQVRPVANQRHYVLNDDGRMMLRDLSASLKENIREQLMEQRVIQHVPADMGGALLKETMQRVLSVDGSGEDAMVSLSKKKDGKKEKNQVKASKLVGVFPEGPSKLKALKAAIEIDGNYGVALDPKPVVIRHIKVFKRIMALKEQNGGKPVRILKKGMLIHLTSSKDPKHAGVWRIESIQDSKGGVKLDLQRAHCAVPKNKTHECNWREVDLISLLKKYQMKRYPTSYTGTPR

SEQ ID NO: 339 - protein, 1424 aa, Prevotella sp. C561
MTQKVLGLDLGTNSIGSAVRNLDLSDDLQWQLEFFSSDIFRSSVNKESNGREYSLAAQRSAHRRSRGLNEVRRRRLWATLNLLIKHGFCPMSSESLMRWCTYDKRKGLFREYPIDDKDFNAWILLDFNGDGRPDYSSPYQLRRELVTRQFDFEQPIERYKLGRALYHIAQHRGFKSSKGETLSQQETNSKPSSTDEIPDVAGAMKASEEKLSKGLSTYMKEHNLLTVGAAFAQLEDEGVRVRNNNDYRAIRSQFQHEIETIFKFQQGLSVESELYERLISEKKNVGTIFYKRPLRSQRGNVGKCTLERSKPRCAIGHPLFEKFRAWTLINNIKVRMSVDTLDEQLPMKLRLDLYNECFLAFVRTEFKFEDIRKYLEKRLGIHFSYNDKTINYKDSTSVAGCPITARFRKMLGEEWESFRVEGQKERQAHSKNNISFHRVSYSIEDIWHFCYDAEEPEAVLAFAQETLRLERKKAEELVRIWSAMPQGYAMLSQKAIRNINKILMLGLKYSDAVILAKVPELVDVSDEELLSIAKDYYLVEAQVNYDKRINSIVNGLIAKYKSVSEEYRFADHNYEYLLDESDEKDIIRQIENSLGARRWSLMDANEQTDILQKVRDRYQDFFRSHERKFVESPKLGESFENYLTKKFPMVEREQWKKLYHPSQITIYRPVSVGKDRSVLRLGNPDIGAIKNPTVLRVLNTLRRRVNQLLDDGVISPDETRVVVETARELNDANRKWALDTYNRIRHDENEKIKKILEEFYPKRDGISTDDIDKARYVIDQREVDYFTGSKTYNKDIKKYKFWLEQGGQCMYTGRTINLSNLFDPNAFDIEHTIPESLSFDSSDMNLTLCDAHYNRFIKKNHIPTDMPNYDKAITIDGKEYPAITSQLQRWVERVERLNRNVEYWKGQARRAQNKDRKDQCMREMHLWKMELEYWKKKLERFTVTEVTDGFKNSQLVDTRVITRHAVLYLKSIFPHVDVQRGDVTAKFRKILGIQSVDEKKDRSLHSHHAIDATTLTIIPVSAKRDRMLELFAKIEEINKMLSFSGSEDRTGLIQELEGLKNKLQMEVKVCRIGHNVSEIGTFINDNIIVNHHIKNQALTPVRRRLRKKGYIVGGVDNPRWQTGDALRGEIHKASYYGAITQFAKDDEGKVLMKEGRPQVNPTIKFVIRRELKYKKSAADSGFASWDDLGKAIVDKELFALMKGQFPAETSFKDACEQGIYMIKKGKNGMPDIKLHHIRHVRCEAPQSGLKIKEQTYKSEKEYKRYFYAAVGDLYAMCCYTNGKIREFRIYSLYDVSCHRKSDIEDIPEFITDKKGNRLMLDYKLRTGDMILLYKDNPAELYDLDNVNLSRRLYKINRFESQSNLVLMTHHLSTSKERGRSLGKTVDYQNLPESIRSSVKSLNFLIMGENRDFVIKNGKIIFNHR

SEQ ID NO: 340 - protein, 1409 aa, Wolinella succinogenes
MLVSPISVDLGGKNTGFFSFTDSLDNSQSGTVIYDESFVLSQVGRRSKRHSKRNNLRNKLVKRLFLLILQEHHGLSIDVLPDEIRGLFNKRGYTYAGFELDEKKKDALESDTLKEFLSEKLQSIDRDSDVEDFLNQIASNAESFKDYKKGFEAVFASATHSPNKKLELKDELKSEYGENAKELLAGLRVTKEILDEFDKQENQGNLPRAKYFEELGEYIATNEKVKSFFDSNSLKLTDMTKLIGNISNYQLKELRRYFNDKEMEKGDIWIPNKLHKITERFVRSWHPKNDADRQRRAELMKDLKSKEIMELLTTTEPVMTIPPYDDMNNRGAVKCQTLRLNEEYLDKHLPNWRDIAKRLNHGKFNDDLADSTVKGYSEDSTLLHRLLDTSKEIDIYELRGKKPNELLVKTLGQSDANRLYGFAQNYYELIRQKVRAGIWVPVKNKDDSLNLEDNSNMLKRCNHNPPHKKNQIHNLVAGILGVKLDEAKFAEFEKELWSAKVGNKKLSAYCKNIEELRKTHGNTFKIDIEELRKKDPAELSKEEKAKLRLTDDVILNEWSQKIANFFDIDDKHRQRFNNLFSMAQLHTVIDTPRSGFSSTCKRCTAENRFRSETAFYNDETGEFHKKATATCQRLPADTQRPFSGKIERYIDKLGYELAKIKAKELEGMEAKEIKVPIILEQNAFEYEESLRKSKTGSNDRVINSKKDRDGKKLAKAKENAEDRLKDKDKRIKAFSSGICPYCGDTIGDDGEIDHILPRSHTLKIYGTVFNPEGNLIYVHQKCNQAKADSIYKLSDIKAGVSAQWIEEQVANIKGYKTFSVLSAEQQKAFRYALFLQNDNEAYKKVVDWLRTDQSARVNGTQKYLAKKIQEKLTKMLPNKHLSFEFILADATEVSELRRQYARQNPLLAKAEKQAPSSHAIDAVMAFVARYQKVFKDGTPPNADEVAKLAMLDSWNPASNEPLTKGLSTNQKIEKMIKSGDYGQKNMREVFGKSIFGENAIGERYKPIVVQEGGYYIGYPATVKKGYELKNCKVVTSKNDIAKLEKIIKNQDLISLKENQYIKIFSINKQTISELSNRYFNMNYKNLVERDKEIVGLLEFIVENCRYYTKKVDVKFAPKYIHETKYPFYDDWRRFDEAWRYLQENQNKTSSKDRFVIDKSSLNEYYQPDKNEYKLDVDTQPIWDDFCRWYFLDRYKTANDKKSIRIKARKTFSLLAESGVQGKVFRAKRKIPTGYAYQALPMDNNVIAGDYANILLEANSKTLSLVPKSGISIEKQLDKKLDVIKKTDVRGLAIDNNSFFNADFDTHGIRLIVENTSVKVGNFPISAIDKSAKRMIFRALFEKEKGKRKKKTTISFKESGPVQDYLKVFLKKIVKIQLRTDGSISNIVVRKNAADFTLSFRSEHIQKLLK

SEQ ID NO: 341 - protein, 1146 aa, Alicyclobacillus hesperidum
MAYRLGLDIGITSVGWAVVALEKDESGLKPVRIQDLGVRIFDKAEDSKTGASLALPRREARSARRRTRRRRHRLWRVKRLLEQHGILSMEQIEALYAQRTSSPDVYALRVAGLDRCLIAEEIARVLIHIAHRRGFQSNRKSEIKDSDAGKLLKAVQENENLMQSKGYRTVAEMLVSEATKTDAEGKLVHGKKHGYVSNVRNKAGEYRHTVSRQAIVDEVRKIFAAQRALGNDVMSEELEDSYLKILCSQRNFDDGPGGDSPYGHGSVSPDGVRQSIYERMVGSCTFETGEKRAPRSSYSFERFQLLTKVVNLRIYRQQEDGGRYPCELTQTERARVIDCAYEQTKITYGKLRKLLDMKDTESFAGLTYGLNRSRNKTEDTVFVEMKFYHEVRKALQRAGVFIQDLSIETLDQIGWILSVWKSDDNRRKKLSTLGLSDNVIEELLPLNGSKFGHLSLKAIRKILPFLEDGYSYDVACELAGYQFQGKTEYVKQRLLPPLGEGEVTNPVVRRALSQAIKVVNAVIRKHGSPESIHIELARELSKNLDERRKIEKAQKENQKNNEQIKDEIREILGSAHVTGRDIVKYKLFKQQQEFCMYSGEKLDVTRLFEPGYAEVDHIIPYGISFDDSYDNKVLVKTEQNRQKGNRTPLEYLRDKPEQKAKFIALVESIPLSQKKKNHLLMDKRAIDLEQEGFRERNLSDTRYITRALMNHIQAWLLFDETASTRSKRVVCVNGAVTAYMRARWGLTKDRDAGDKHHAADAVVVACIGDSLIQRVTKYDKFKRNALADRNRYVQQVSKSEGITQYVDKETGEVFTWESFDERKFLPNEPLEPWPFFRDELLARLSDDPSKNIRAIGLLTYSETEQIDPIFVSRMPTRKVTGAAHKETIRSPRIVKVDDNKGTEIQVVVSKVALTELKLTKDGEIKDYFRPEDDPRLYNTLRERLVQFGGDAKAAFKEPVYKISKDGSVRTPVRKVKIQEKLTLGVPVHGGRGIAENGGMVRIDVFAKGGKYYFVPIYVADVLKRELPNRLATAHKPYSEWRVVDDSYQFKFSLYPNDAVMIKPSREVDITYKDRKEPVGCRIMYFVSANIASASISLRTHDNSGELEGLGIQGLEVFEKYVVGPLGDTHPVYKERRMPFRVERKMN

SEQ ID NO: 342 - protein, 1442 aa, Caenispirillum salinarum
MPVLSPLSPNAAQGRRRWSLALDIGEGSIGWAVAEVDAEGRVLQLTGTGVTLFPSAWSNENGTYVAHGAADRAVRGQQQRHDSRRRRLAGLARLCAPVLERSPEDLKDLTRTPPKADPRAIFFLRADAARRPLDGPELFRVLHHMAAHRGIRLAELQEVDPPPESDADDAAPAATEDEDGTRRAAADERAFRRLMAEHMHRHGTQPTCGEIMAGRLRETPAGAQPVTRARDGLRVGGGVAVPTRALIEQEFDAIRAIQAPRHPDLPWDSLRRLVLDQAPIAVPPATPCLFLEELRRRGETFQGRTITREAIDRGLTVDPLIQALRIRETVGNLRLHERITEPDGRQRYVPRAMPELGLSHGELTAPERDTLVRALMHDPDGLAAKDGRIPYTRLRKLIGYDNSPVCFAQERDTSGGGITVNPTDPLMARWIDGWVDLPLKARSLYVRDVVARGADSAALARLLAEGAHGVPPVAAAAVPAATAAILESDIMQPGRYSVCPWAAEAILDAWANAPTEGFYDVTRGLFGFAPGEIVLEDLRRARGALLAHLPRTMAAARTPNRAAQQRGPLPAYESVIPSQLITSLRRAHKGRAADWSAADPEERNPFLRTWTGNAATDHILNQVRKTANEVITKYGNRRGWDPLPSRITVELAREAKHGVIRRNEIAKENRENEGRRKKESAALDTFCQDNTVSWQAGGLPKERAALRLRLAQRQEFFCPYCAERPKLRATDLFSPAETEIDHVIERRMGGDGPDNLVLAHKDCNNAKGKKTPHEHAGDLLDSPALAALWQGWRKENADRLKGKGHKARTPREDKDFMDRVGWRFEEDARAKAEENQERRGRRMLHDTARATRLARLYLAAAVMPEDPAEIGAPPVETPPSPEDPTGYTAIYRTISRVQPVNGSVTHMLRQRLLQRDKNRDYQTHHAEDACLLLLAGPAVVQAFNTEAAQHGADAPDDRPVDLMPTSDAYHQQRRARALGRVPLATVDAALADIVMPESDRQDPETGRVHWRLTRAGRGLKRRIDDLTRNCVILSRPRRPSETGTPGALHNATHYGRREITVDGRTDTVVTQRMNARDLVALLDNAKIVPAARLDAAAPGDTILKEICTEIADRHDRVVDPEGTHARRWISARLAALVPAHAEAVARDIAELADLDALADADRTPEQEARRSALRQSPYLGRAISAKKADGRARAREQEILTRALLDPHWGPRGLRHLIMREARAPSLVRIRANKTDAFGRPVPDAAVWVKTDGNAVSQLWRLTSVVTDDGRRIPLPKPIEKRIEISNLEYARLNGLDEGAGVTGNNAPPRPLRQDIDRLTPLWRDHGTAPGGYLGTAVGELEDKARSALRGKAMRQTLTDAGITAEAGWRLDSEGAVCDLEVAKGDTVKKDGKTYKVGVITQGIFGMPVDAAGSAPRTPEDCEKFEEQYGIKPWKAKGIPLA

SEQ ID NO: 343 - protein, 1114 aa, Eubacterium rectale
MNYTEKEKLFMKYILALDIGIASVGWAILDKESETVIEAGSNIFPEASAADNQLRRDMRGAKRNNRRLKTRINDFIKLWENNNLSIPQFKSTEIVGLKVRAITEEITLDELYLILYSYLKHRGISYLEDALDDTVSGSSAYANGLKLNAKELETHYPCEIQQERLNTIGKYRGQSQIINENGEVLDLSNVFTIGAYRKEIQRVFEIQKKYHPELTDEFCDGYMLIFNRKRKYYEGPGNEKSRTDYGRFTTKLDANGNYITEDNIFEKLIGKCSVYPDELRAAAASYTAQEYNVLNDLNNLTINGRKLEENEKHEIVERIKSSNTINMRKIISDCMGENIDDFAGARIDKSGKEIFHKFEVYNKMRKALLEIGIDISNYSREELDEIGYIMTINTDKEAMMEAFQKSWIDLSDDVKQCLINMRKTNGALFNKWQSFSLKIMNELIPEMYAQPKEQMTLLTEMGVTKGTQEEFAGLKYIPVDVVSEDIFNPVVRRSVRISFKILNAVLKKYKALDTIVIEMPRDRNSEEQKKRINDSQKLNEKEMEYIEKKLAVTYGIKLSPSDFSSQKQLSLKLKLWNEQDGICLYSGKTIDPNDIINNPQLFEIDHIIPRSISFDDARSNKVLVYRSENQKKGNQTPYYYLTHSHSEWSFEQYKATVMNLSKKKEYAISRKKIQNLLYSEDITKMDVLKGFINRNINDTSYASRLVLNTIQNFFMANEADTKVKVIKGSYTHQMRCNLKLDKNRDESYSHHAVDAMLIGYSELGYEAYHKLQGEFIDFETGEILRKDMWDENMSDEVYADYLYGKKWANIRNEVVKAEKNVKYWHYVMRKSNRGLCNQTIRGTREYDGKQYKINKLDIRTKEGIKVFAKLAFSKKDSDRERLLVYLNDRRTFDDLCKIYEDYSDAANPFVQYEKETGDIIRKYSKKHNGPRIDKLKYKDGEVGACIDISHKYGFEKGSKKVILESLVPYRMDVYYKEENHSYYLVGVKQSDIKFEKGRNVIDEEAYARILVNEKMIQPGQSRADLENLGFKFKLSFYKNDIIEYEKDGKIYTERLVSRTMPKQRNYIETKPIDKAKFEKQNLVGLGKTKFIKKYRYDILGNKYSCSEEKFTSFC

SEQ ID NO: 344 - protein, 1314 aa, Mycoplasma synoviae
MLRLYCANNLVLNNVQNLWKYLLLLIFDKKIIFLFKIKVILIRRYMENNNKEKIVIGFDLGVASVGWSIVNAETKEVIDLGVRLFSEPEKADYRRAKRTTRRLLRRKKFKREKFHKLILKNAEIFGLQSRNEILNVYKDQSSKYRNILKLKINALKEEIKPSELVWILRDYLQNRGYFYKNEKLTDEFVSNSFPSKKLHEHYEKYGFFRGSVKLDNKLDNKKDKAKEKDEEEESDAKKESEELIFSNKQWINEIVKVFENQSYLTESFKEEYLKLFNYVRPFNKGPGSKNSRTAYGVFSTDIDPETNKFKDYSNIWDKTIGKCSLFEEEIRAPKNLPSALIFNLQNEICTIKNEFTEFKNWWLNAEQKSEILKFVFTELFNWKDKKYSDKKFNKNLQDKIKKYLLNFALENFNLNEEILKNRDLENDTVLGLKGVKYYEKSNATADAALEFSSLKPLYVFIKFLKEKKLDLNYLLGLENTEILYFLDSIYLAISYSSDLKERNEWFKKLLKELYPKIKNNNLEIIENVEDIFEITDQEKFESFSKTHSLSREAFNHIIPLLLSNNEGKNYESLKHSNEELKKRTEKAELKAQQNQKYLKDNFLKEALVPLSVKTSVLQAIKIFNQIIKNFGKKYEISQVVIEMARELTKPNLEKLLNNATNSNIKILKEKLDQTEKFDDFTKKKFIDKIENSVVFRNKLFLWFEQDRKDPYTQLDIKINEIEDETEIDHVIPYSKSADDSWFNKLLVKKSTNQLKKNKTVWEYYQNESDPEAKWNKFVAWAKRIYLVQKSDKESKDNSEKNSIFKNKKPNLKFKNITKKLFDPYKDLGFLARNLNDTRYATKVFRDQLNNYSKHHSKDDENKLFKVVCMNGSITSFLRKSMWRKNEEQVYRFNFWKKDRDQFFHHAVDASIIAIFSLLTKTLYNKLRVYESYDVQRREDGVYLINKETGEVKKADKDYWKDQHNFLKIRENAIEIKNVLNNVDFQNQVRYSRKANTKLNTQLFNETLYGVKEFENNFYKLEKVNLFSRKDLRKFILEDLNEESEKNKKNENGSRKRILTEKYIVDEILQILENEEFKDSKSDINALNKYMDSLPSKFSEFFSQDFINKCKKENSLILTFDAIKHNDPKKVIKIKNLKFFREDATLKNKQAVHKDSKNQIKSFYESYKCVGFIWLKNKNDLEESIFVPINSRVIHFGDKDKDIFDFDSYNKEKLLNEINLKRPENKKFNSINEIEFVKFVKPGALLLNFENQQIYYISTLESSSLRAKIKLLNKMDKGKAVSMKKITNPDEYKIIEHVNPLGINLNWTKKLENNN

SEQ ID NO: 345 - protein, 1197 aa, Porphyromonas sp. oral taxon 279 str. F0450
MLMSKHVLGLDLGVGSIGWCLIALDAQGDPAEILGMGSRVVPLNNATKAIEAFNAGAAFTASQERTARRTMRRGFARYQLRRYRLRRELEKVGMLPDAALIQLPLLELWELRERAATAGRRLTLPELGRVLCHINQKRGYRHVKSDAAAIVGDEGEKKKDSNSAYLAGIRANDEKLQAEHKTVGQYFAEQLRQNQSESPTGGISYRIKDQIFSRQCYIDEYDQIMAVQRVHYPDILTDEFIRMLRDEVIFMQRPLKSCKHLVSLCEFEKQERVMRVQQDDGKGGWQLVERRVKFGPKVAPKSSPLFQLCCIYEAVNNIRLTRPNGSPCDITPEERAKIVAHLQSSASLSFAALKKLLKEKALIADQLTSKSGLKGNSTRVALASALQPYPQYHHLLDMELETRMMTVQLTDEETGEVTEREVAVVTDSYVRKPLYRLWHILYSIEEREAMRRALITQLGMKEEDLDGGLLDQLYRLDFVKPGYGNKSAKFICKLLPQLQQGLGYSEACAAVGYRHSNSPTSEEITERTLLEKIPLLQRNELRQPLVEKILNQMINLVNALKAEYGIDEVRVELARELKMSREERERMARNNKDREERNKGVAAKIRECGLYPTKPRIQKYMLWKEAGRQCLYCGRSIEEEQCLREGGMEVEHIIPKSVLYDDSYGNKTCACRRCNKEKGNRTALEYIRAKGREAEYMKRINDLLKEKKISYSKHQRLRWLKEDIPSDFLERQLRLTQYISRQAMAILQQGIRRVSASEGGVTARLRSLWGYGKILHTLNLDRYDSMGETERVSREGEATEELHITNWSKRMDHRHHAIDALVVACTRQSYIQRLNRLSSEFGREDKKKEDQEAQEQQATETGRLSNLERWLTQRPHFSVRTVSDKVAEILISYRPGQRVVTRGRNIYRKKMADGREVSCVQRGVLVPRGELMEASFYGKILSQGRVRIVKRYPLHDLKGEVVDPHLRELITTYNQELKSREKGAPIPPLCLDKDKKQEVRSVRCYAKTLSLDKAIPMCFDEKGEPTAFVKSASNHHLALYRTPKGKLVESIVTFWDAVDRARYGIPLVITHPREVMEQVLQRGDIPEQVLSLLPPSDWVFVDSLQQDEMVVIGLSDEELQRALEAQNYRKISEHLYRVQKMSSSYYVFRYHLETSVADDKNTSGRIPKFHRVQSLKAYEERNIRKVRVDLLGRISLL

SEQ ID NO: 346 - protein, 1121 aa, Streptococcus thermophilus
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 347 - protein, 1152 aa, Roseburia inulinivorans
MNAEHGKEGLLIMEENFQYRIGLDIGITSVGWAVLQNNSQDEPVRITDLGVRIFDVAENPKNGDALAAPRRDARTTRRRLRRRRHRLERIKFLLQENGLIEMDSFMERYYKGNLPDVYQLRYEGLDRKLKDEELAQVLIHIAKHRGFRSTRKAETKEKEGGAVLKATTENQKIMQEKGYRTVGEMLYLDEAFHTECLWNEKGYVLTPRNRPDDYKHTILRSMLVEEVHAIFAAQRAHGNQKATEGLEEAYVEIMTSQRSFDMGPGLQPDGKPSPYAMEGFGDRVGKCTFEKDEYRAPKATYTAELFVALQKINHTKLIDEFGTGRFFSEEERKTIIGLLLSSKELKYGTIRKKLNIDPSLKFNSLNYSAKKEGETEEERVLDTEKAKFASMFWTYEYSKCLKDRTEEMPVGEKADLFDRIGEILTAYKNDDSRSSRLKELGLSGEEIDGLLDLSPAKYQRVSLKAMRKMQPYLEDGLIYDKACEAAGYDFRALNDGNKKHLLKGEEINAIVNDITNPVVKRSVSQTIKVINAIIQKYGSPQAVNIELAREMSKNFQDRTNLEKEMKKRQQENERAKQQIIELGKQNPTGQDILKYRLWNDQGGYCLYSGKKIPLEELFDGGYDIDHILPYSITFDDSYRNKVLVTAQENRQKGNRTPYEYFGADEKRWEDYEASVRLLVRDYKKQQKLLKKNFTEEERKEFKERNLNDTKYITRVVYNMIRQNLELEPFNHPEKKKQVWAVNGAVTSYLRKRWGLMQKDRSTDRHHAMDAVVIACCTDGMIHKISRYMQGRELAYSRNFKFPDEETGEILNRDNFTREQWDEKFGVKVPLPWNSFRDELDIRLLNEDPKNFLLTHADVQRELDYPGWMYGEEESPIEEGRYINYIRPLFVSRMPNHKVTGSAHDATIRSARDYETRGVVITKVPLTDLKLNKDNEIEGYYDKDSDRLLYQALVRQLLLHGNDGKKAFAEDFHKPKADGTEGPVVRKVKIEKKQTSGVMVRGGTGIAANGEMVRIDVFRENGKYYFVPVYTADVVRKVLPNRAATHTKPYSEWRVMDDANFVFSLYSRDLIHVKSKKDIKTNLVNGGLLLQKEIFAYYTGADIATASIAGFANDSNFKFRGLGIQSLEIFEKCQVDILGNISVVRHENRQEFH

SEQ ID NO: 348 - protein, 1082 aa, Methylosinus trichosporium
MRVLGLDAGIASLGWALIEIEESNRGELSQGTIIGAGTWMFDAPEEKTQAGAKLKSEQRRTFRGQRRVVRRRRQRMNEVRRILHSHGLLPSSDRDALKQPGLDPWRIRAEALDRLLGPVELAVALGHIARHRGFKSNSKGAKTNDPADDTSKMKRAVNETREKLARFGSAAKMLVEDESFVLRQTPTKNGASEIVRRFRNREGDYSRSLLRDDLAAEMRALFTAQARFQSAIATADLQTAFTKAAFFQRPLQDSEKLVGPCPFEVDEKRAPKRGYSFELFRFLSRLNHVTLRDGKQERTLTRDELALAAADFGAAAKVSFTALRKKLKLPETTVFVGVKADEESKLDVVARSGKAAEGTARLRSVIVDALGELAWGALLCSPEKLDKIAEVISFRSDIGRISEGLAQAGCNAPLVDALTAAASDGRFDPFTGAGHISSKAARNILSGLRQGMTYDKACCAADYDHTASRERGAFDVGGHGREALKRILQEERISRELVGSPTARKALIESIKQVKAIVERYGVPDRIHVELARDVGKSIEEREEITRGIEKRNRQKDKLRGLFEKEVGRPPQDGARGKEELLRFELWSEQMGRCLYTDDYISPSQLVATDDAVQVDHILPWSRFADDSYANKTLCMAKANQDKKGRTPYEWFKAEKTDTEWDAFIVRVEALADMKGFKKRNYKLRNAEEAAAKFRNRNLNDTRWACRLLAEALKQLYPKGEKDKDGKERRRVFSRPGALTDRLRRAWGLQWMKKSTKGDRIPDDRHHALDAIVIAATTESLLQRATREVQEIEDKGLHYDLVKNVTPPWPGFREQAVEAVEKVFVARAERRRARGKAHDATIRHIAVREGEQRVYERRKVAELKLADLDRVKDAERNARLIEKLRNWIEAGSPKDDPPLSPKGDPIFKVRLVTKSKVNIALDTGNPKRPGTVDRGEMARVDVFRKASKKGKYEYYLVPIYPHDIATMKTPPIRAVQAYKPEDEWPEMDSSYEFCWSLVPMTYLQVISSKGEIFEGYYRGMNRSVGAIQLSAHSNSSDVVQGIGARTLTEFKKFNVDRFGRKHEVERELRTWRGETWRGKAYI

SEQ ID NO: 349 - protein, 1156 aa, Ruminococcus albus
MGNYYLGLDVGIGSIGWAVINIEKKRIEDFNVRIFKSGEIQEKNRNSRASQQCRRSRGLRRLYRRKSHRKLRLKNYLSIIGLTTSEKIDYYYETADNNVIQLRNKGLSEKLTPEEIAACLIHICNNRGYKDFYEVNVEDIEDPDERNEYKEEHDSIVLISNLMNEGGYCTPAEMICNCREFDEPNSVYRKFHNSAASKNHYLITRHMLVKEVDLILENQSKYYGILDDKTIAKIKDIIFAQRDFEIGPGKNERFRRFTGYLDSIGKCQFFKDQERGSRFTVIADIYAFVNVLSQYTYTNNRGESVFDTSFANDLINSALKNGSMDKRELKAIAKSYHIDISDKNSDTSLTKCFKYIKVVKPLFEKYGYDWDKLIENYTDTDNNVLNRIGIVLSQAQTPKRRREKLKALNIGLDDGLINELTKLKLSGTANVSYKYMQGSIEAFCEGDLYGKYQAKFNKEIPDIDENAKPQKLPPFKNEDDCEFFKNPVVFRSINETRKLINAIIDKYGYPAAVNIETADELNKTFEDRAIDTKRNNDNQKENDRIVKEIIECIKCDEVHARHLIEKYKLWEAQEGKCLYSGETITKEDMLRDKDKLFEVDHIVPYSLILDNTINNKALVYAEENQKKGQRTPLMYMNEAQAADYRVRVNTMFKSKKCSKKKYQYLMLPDLNDQELLGGWRSRNLNDTRYICKYLVNYLRKNLRFDRSYESSDEDDLKIRDHYRVFPVKSRFTSMFRRWWLNEKTWGRYDKAELKKLTYLDHAADAIIIANCRPEYVVLAGEKLKLNKMYHQAGKRITPEYEQSKKACIDNLYKLFRMDRRTAEKLLSGHGRLTPIIPNLSEEVDKRLWDKNIYEQFWKDDKDKKSCEELYRENVASLYKGDPKFASSLSMPVISLKPDHKYRGTITGEEAIRVKEIDGKLIKLKRKSISEITAESINSIYTDDKILIDSLKTIFEQADYKDVGDYLKKTNQHFFTTSSGKRVNKVTVIEKVPSRWLRKEIDDNNFSLLNDSSYYCIELYKDSKGDNNLQGIAMSDIVHDRKTKKLYLKPDFNYPDDYYTHVMYIFPGDYLRIKSTSKKSGEQLKFEGYFISVKNVNENSFRFISDNKPCAKDKRVSITKKDIVIKLAVDLMGKVQGENNGKGISCGEPLSLLKEKN

SEQ ID NO: 350 - protein, 1187 aa, Bifidobacterium longum
MLSRQLLGASHLARPVSYSYNVQDNDVHCSYGERCFMRGKRYRIGIDVGLNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPAQLVVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWVVDGFFNQTQLRIRPRYLAAEGLAKAFSDDVVPDGVQKIVTKQGWLPPVNTASKTAVRIVRRNAFGEPRLSSAHHMPCSWQWRHE

SEQ ID NO: 351 - protein, 1150 aa, Enterococcus faecalis
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTEPLSRGEIYKVTLHILKKRGISYLDEVDTEAAKESQDYKEQVRKNAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFQKTGEPATNIFDKLIGKDFQGELRASGLSLSAQQYNLLNDLTNLKIDGEVPLSSEQKEYILTELMTKEFTRFGVNDVVKLLGVKKERLSGWRLDKKGKPEIHTLKGYRNWRKIFAEAGIDLATLPTETIDCLAKVLTLNTEREGIENTLAFELPELSESVKLLVLDRYKELSQSISTQSWHRFSLKTLHLLIPELMNATSEQNTLLEQFQLKSDVRKRYSEYKKLPTKDVLAEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLPISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFTNQETKVRVVNGSFTHTLRKKWGADLDKTRETHHHHAVDATLCAVTSFVKVSRYHYAVKEETGEKVMREIDFETGEIVNEMSYWEFKKSKKYERKTYQVKWPNFREQLKPVNLHPRIKFSHQVDRKANRKLSDATIYSVREKTEVKTLKSGKQKITTDEYTIGKIKDIYTLDGWEAFKKKQDKLLMKDLDEKTYERLLSIAETTPDFQEVEEKNGKVKRVKRSPFAVYCEENDIPAIQKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQRYDVRFYNFQSANSINFKGLEQEMMPAENQFKQKPYNNGAINLNIAKYGKEGKKLRKFNTDILGKKHYLFYEKEPKNIIK

SEQ ID NO: 352 - protein, 1236 aa, Mycoplasma mobile
MYFYKNKENKLNKKVVLGLDLGIASVGWCLTDISQKEDNKFPIILHGVRLFETVDDSDDKLLNETRRKKRGQRRRNRRLFTRKRDFIKYLIDNNIIELEFDKNPKILVRNFIEKYINPFSKNLELKYKSVTNLPIGFHNLRKAAINEKYKLDKSELIVLLYFYLSLRGAFFDNPEDTKSKEMNKNEIEIFDKNESIKNAEFPIDKIIEFYKISGKIRSTINLKFGHQDYLKEIKQVFEKQNIDFMNYEKFAMEEKSFFSRIRNYSEGPGNEKSFSKYGLYANENGNPELIINEKGQKIYTKIFKTLWESKIGKCSYDKKLYRAPKNSFSAKVFDITNKLTDWKHKNEYISERLKRKILLSRFLNKDSKSAVEKILKEENIKFENLSEIAYNKDDNKINLPIINAYHSLTTIFKKHLINFENYLISNENDLSKLMSFYKQQSEKLFVPNEKGSYEINQNNNVLHIFDAISNILNKFSTIQDRIRILEGYFEFSNLKKDVKSSEIYSEIAKLREFSGTSSLSFGAYYKFIPNLISEGSKNYSTISYEEKALQNQKNNFSHSNLFEKTWVEDLIASPTVKRSLRQTMNLLKEIFKYSEKNNLEIEKIVVEVTRSSNNKHERKKIEGINKYRKEKYEELKKVYDLPNENTTLLKKLWLLRQQQGYDAYSLRKIEANDVINKPWNYDIDHIVPRSISFDDSFSNLVIVNKLDNAKKSNDLSAKQFIEKIYGIEKLKEAKENWGNWYLRNANGKAFNDKGKFIKLYTIDNLDEFDNSDFINRNLSDTSYITNALVNHLTFSNSKYKYSVVSVNGKQTSNLRNQIAFVGIKNNKETEREWKRPEGFKSINSNDFLIREEGKNDVKDDVLIKDRSFNGHHAEDAYFITIISQYFRSFKRIERLNVNYRKETRELDDLEKNNIKFKEKASFDNFLLINALDELNEKLNQMRFSRMVITKKNTQLFNETLYSGKYDKGKNTIKKVEKLNLLDNRTDKIKKIEEFFDEDKLKENELTKLHIFNHDKNLYETLKIIWNEVKIEIKNKNLNEKNYFKYFVNKKLQEGKISFNEWVPILDNDFKIIRKIRYIKFSSEEKETDEIIFSQSNFLKIDQRQNFSFHNTLYWVQIWVYKNQKDQYCFISIDARNSKFEKDEIKINYEKLKTQKEKLQIINEEPILKINKGDLFENEEKELFYIVGRDEKPQKLEIKYILGKKIKDQKQIQKPVKKYFPNWKKVNLTYMGEIFKK

SEQ ID NO: 353 - protein, 1105 aa, Actinomyces coleocanis
MDNKNYRIGIDVGLNSIGFCAVEVDQHDTPLGFLNLSVYRHDAGIDPNGKKTNTTRLAMSGVARRTRRLFRKRKRRLAALDRFIEAQGWTLPDHADYKDPYTPWLVRAELAQTPIRDENDLHEKLAIAVRHIARHRGWRSPWVPVRSLHVEQPPSDQYLALKERVEAKTLLQMPEGATPAEMVVALDLSVDVNLRPKNREKTDTRPENKKPGFLGGKLMQSDNANELRKIAKIQGLDDALLRELIELVFAADSPKGASGELVGYDVLPGQHGKRRAEKAHPAFQRYRIASIVSNLRIRHLGSGADERLDVETQKRVFEYLLNAKPTADITWSDVAEEIGVERNLLMGTATQTADGERASAKPPVDVTNVAFATCKIKPLKEWWLNADYEARCVMVSALSHAEKLTEGTAAEVEVAEFLQNLSDEDNEKLDSFSLPIGRAAYSVDSLERLTKRMIENGEDLFEARVNEFGVSEDWRPPAEPIGARVGNPAVDRVLKAVNRYLMAAEAEWGAPLSVNIEHVREGFISKRQAVEIDRENQKRYQRNQAVRSQIADHINATSGVRGSDVTRYLAIQRQNGECLYCGTAITFVNSEMDHIVPRAGLGSTNTRDNLVATCERCNKSKSNKPFAVWAAECGIPGVSVAEALKRVDFWIADGFASSKEHRELQKGVKDRLKRKVSDPEIDNRSMESVAWMARELAHRVQYYFDEKHTGTKVRVFRGSLTSAARKASGFESRVNFIGGNGKTRLDRRHHAMDAATVAMLRNSVAKTLVLRGNIRASERAIGAAETWKSFRGENVADRQIFESWSENMRVLVEKFNLALYNDEVSIFSSLRLQLGNGKAHDDTITKLQMHKVGDAWSLTEIDRASTPALWCALTRQPDFTWKDGLPANEDRTIIVNGTHYGPLDKVGIFGKAAASLLVRGGSVDIGSAIHHARIYRIAGKKPTYGMVRVFAPDLLRYRNEDLFNVELPPQSVSMRYAEPKVREAIREGKAEYLGWLVVGDELLLDLSSETSGQIAELQQDFPGTTHWTVAGFFSPSRLRLRPVYLAQEGLGEDVSEGSKSIIAGQGWRPAVNKVFGSAMPEVIRRDGLGRKRRFSYSGLPVSWQG

SEQ ID NO: 354 - protein, 1079 aa, Dinoroseobacter shibae
MRLGLDIGTSSIGWWLYETDGAGSDARITGVVDGGVRIFSDGRDPKSGASLAVDRRAARAMRRRRDRYLRRRATLMKVLAETGLMPADPAEAKALEALDPFALRAAGLDEPLPLPHLGRALFHLNQRRGFKSNRKTDRGDNESGKIKDATARLDMEMMANGARTYGEFLHKRRQKATDPRHVPSVRTRLSIANRGGPDGKEEAGYDFYPDRRHLEEEFHKLWAAQGAHHPELTETLRDLLFEKIFFQRPLKEPEVGLCLFSGHHGVPPKDPRLPKAHPLTQRRVLYETVNQLRVTADGREARPLTREERDQVIHALDNKKPTKSLSSMVLKLPALAKVLKLRDGERFTLETGVRDAIACDPLRASPAHPDRFGPRWSILDADAQWEVISRIRRVQSDAEHAALVDWLTEAHGLDRAHAEATAHAPLPDGYGRLGLTATTRILYQLTADVVTYADAVKACGWHHSDGRTGECFDRLPYYGEVLERHVIPGSYHPDDDDITRFGRITNPTVHIGLNQLRRLVNRIIETHGKPHQIVVELARDLKKSEEQKRADIKRIRDTTEAAKKRSEKLEELEIEDNGRNRMLLRLWEDLNPDDAMRRFCPYTGTRISAAMIFDGSCDVDHILPYSRTLDDSFPNRTLCLREANRQKRNQTPWQAWGDTPHWHAIAANLKNLPENKRWRFAPDAMTRFEGENGFLDRALKDTQYLARISRSYLDTLFTKGGHVWVVPGRFTEMLRRHWGLNSLLSDAGRGAVKAKNRTDHRHHAIDAAVIAATDPGLLNRISRAAGQGEAAGQSAELIARDTPPPWEGFRDDLRVRLDRIIVSHRADHGRIDHAARKQGRDSTAGQLHQETAYSIVDDIHVASRTDLLSLKPAQLLDEPGRSGQVRDPQLRKALRVATGGKTGKDFENALRYFASKPGPYQAIRRVRIIKPLQAQARVPVPAQDPIKAYQGGSNHLFEIWRLPDGEIEAQVITSFEAHTLEGEKRPHPAAKRLLRVHKGDMVALERDGRRVVGHVQKMDIANGLFIVPHNEANADTRNNDKSDPFKWIQIGARPAIASGIRRVSVDEIGRLRDGGTRPI

SEQ ID NO: 355 - protein, 1181 aa, Actinomyces sp. oral taxon 180 str. F0310
MLHCIAVIRVPPSEEPGFFETHADSCALCHHGCMTYAANDKAIRYRVGIDVGLRSIGFCAVEVDDEDHPIRILNSVVHVHDAGTGGPGETESLRKRSGVAARARRRGRAEKQRLKKLDVLLEELGWGVSSNELLDSHAPWHIRKRLVSEYIEDETERRQCLSVAMAHIARHRGWRNSFSKVDTLLLEQAPSDRMQGLKERVEDRTGLQFSEEVTQGELVATLLEHDGDVTIRGFVRKGGKATKVHGVLEGKYMQSDLVAELRQICRTQRVSETTFEKLVLSIFHSKEPAPSAARQRERVGLDELQLALDPAAKQPRAERAHPAFQKFKVVATLANMRIREQSAGERSLTSEELNRVARYLLNHTESESPTWDDVARKLEVPRHRLRGSSRASLETGGGLTYPPVDDTTVRVMSAEVDWLADWWDCANDESRGHMIDAISNGCGSEPDDVEDEEVNELISSATAEDMLKLELLAKKLPSGRVAYSLKTLREVTAAILETGDDLSQAITRLYGVDPGWVPTPAPIEAPVGNPSVDRVLKQVARWLKFASKRWGVPQTVNIEHTREGLKSASLLEEERERWERFEARREIRQKEMYKRLGISGPFRRSDQVRYEILDLQDCACLYCGNEINFQTFEVDHIIPRVDASSDSRRTNLAAVCHSCNSAKGGLAFGQWVKRGDCPSGVSLENAIKRVRSWSKDRLGLTEKAMGKRKSEVISRLKTEMPYEEFDGRSMESVAWMAIELKKRIEGYFNSDRPEGCAAVQVNAYSGRLTACARRAAHVDKRVRLIRLKGDDGHHKNRFDRRNHAMDALVIALMTPAIARTIAVREDRREAQQLTRAFESWKNFLGSEERMQDRWESWIGDVEYACDRLNELIDADKIPVTENLRLRNSGKLHADQPESLKKARRGSKRPRPQRYVLGDALPADVINRVTDPGLWTALVRAPGFDSQLGLPADLNRGLKLRGKRISADFPIDYFPTDSPALAVQGGYVGLEFHHARLYRIIGPKEKVKYALLRVCAIDLCGIDCDDLFEVELKPSSISMRTADAKLKEAMGNGSAKQIGWLVLGDEIQIDPTKFPKQSIGKFLKECGPVSSWRVSALDTPSKITLKPRLLSNEPLLKTSRVGGHESDLVVAECVEKIMKKTGWVVEINALCQSGLIRVIRRNALGEVRTSPKSGLPISLNLR

SEQ ID NO: 356 - protein, 1113 aa, Alcanivorax sp. W11-5
MRYRVGLDLGTASVGAAVFSMDEQGNPMELIWHYERLFSEPLVPDMGQLKPKKAARRLARQQRRQIDRRASRLRRIAIVSRRLGIAPGRNDSGVHGNDVPTLRAMAVNERIELGQLRAVLLRMGKKRGYGGTFKAVRKVGEAGEVASGASRLEEEMVALASVQNKDSVTVGEYLAARVEHGLPSKLKVAANNEYYAPEYALFRQYLGLPAIKGRPDCLPNMYALRHQIEHEFERIWATQSQFHDVMKDHGVKEEIRNAIFFQRPLKSPADKVGRCSLQTNLPRAPRAQIAAQNFRIEKQMADLRWGMGRRAEMLNDHQKAVIRELLNQQKELSFRKIYKELERAGCPGPEGKGLNMDRAALGGRDDLSGNTTLAAWRKLGLEDRWQELDEVTQIQVINFLADLGSPEQLDTDDWSCRFMGKNGRPRNFSDEFVAFMNELRMTDGFDRLSKMGFEGGRSSYSIKALKALTEWMIAPHWRETPETHRVDEEAAIRECYPESLATPAQGGRQSKLEPPPLTGNEVVDVALRQVRHTINMMIDDLGSVPAQIVVEMAREMKGGVTRRNDIEKQNKRFASERKKAAQSIEENGKTPTPARILRYQLWIEQGHQCPYCESNISLEQALSGAYTNFEHILPRTLTQIGRKRSELVLAHRECNDEKGNRTPYQAFGHDDRRWRIVEQRANALPKKSSRKTRLLLLKDFEGEALTDESIDEFADRQLHESSWLAKVTTQWLSSLGSDVYVSRGSLTAELRRRWGLDTVIPQVRFESGMPVVDEEGAEITPEEFEKFRLQWEGHRVTREMRTDRRPDKRIDHRHHLVDAIVTALTSRSLYQQYAKAWKVADEKQRHGRVDVKVELPMPILTIRDIALEAVRSVRISHKPDRYPDGRFFEATAYGIAQRLDERSGEKVDWLVSRKSLTDLAPEKKSIDVDKVRANISRIVGEAIRLHISNIFEKRVSKGMTPQQALREPIEFQGNILRKVRCFYSKADDCVRIEHSSRRGHHYKMLLNDGFAYMEVPCKEGILYGVPNLVRPSEAVGIKRAPESGDFIRFYKGDTVKNIKTGRVYTIKQILGDGGGKLILTPVTETKPADLLSAKWGRLKVGGRNIHLLRLCAE

SEQ ID NO: 357 - protein, 1052 aa, Aminomonas paucivorans
MIGEHVRGGCLFDDHWTPNWGAFRLPNTVRTFTKAENPKDGSSLAEPRRQARGLRRRLRRKTQRLEDLRRLLAKEGVLSLSDLETLFRETPAKDPYQLRAEGLDRPLSFPEWVRVLYHITKHRGFQSNRRNPVEDGQERSRQEEEGKLLSGVGENERLLREGGYRTAGEMLARDPKFQDHRRNRAGDYSHTLSRSLLLEEARRLFQSQRTLGNPHASSNLEEAFLHLVAFQNPFASGEDIRNKAGHCSLEPDQIRAPRRSASAETFMLLQKTGNLRLIHRRTGEERPLTDKEREQIHLLAWKQEKVTHKTLRRHLEIPEEWLFTGLPYHRSGDKAEEKLFVHLAGIHEIRKALDKGPDPAVWDTLRSRRDLLDSIADTLTFYKNEDEILPRLESLGLSPENARALAPLSFSGTAHLSLSALGKLLPHLEEGKSYTQARADAGYAAPPPDRHPKLPPLEEADWRNPVVFRALTQTRKVVNALVRRYGPPWCIHLETARELSQPAKVRRRIETEQQANEKKKQQAEREFLDIVGTAPGPGDLLKMRLWREQGGFCPYCEEYLNPTRLAEPGYAEMDHILPYSRSLDNGWHNRVLVHGKDNRDKGNRTPFEAFGGDTARWDRLVAWVQASHLSAPKKRNLLREDFGEEAERELKDRNLTDTRFITKTAATLLRDRLTFHPEAPKDPVMTLNGRLTAFLRKQWGLHKNRKNGDLHHALDAAVLAVASRSFVYRLSSHNAAWGELPRGREAENGFSLPYPAFRSEVLARLCPTREEILLRLDQGGVGYDEAFRNGLRPVFVSRAPSRRLRGKAHMETLRSPKWKDHPEGPRTASRIPLKDLNLEKLERMVGKDRDRKLYEALRERLAAFGGNGKKAFVAPFRKPCRSGEGPLVRSLRIFDSGYSGVELRDGGEVYAVADHESMVRVDVYAKKNRFYLVPVYVADVARGIVKNRAIVAHKSEEEWDLVDGSFDFRFSLFPGDLVEIEKKDGAYLGYYKSCHRGDGRLLLDRHDRMPRESDCGTFYVSTRKDVLSMSKYQVDPLGEIRLVGSEKPPFVL

SEQ ID NO: 358 - protein, 1233 aa, Mycoplasma canis
MEKKRKVTLGFDLGIASVGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTVESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSVDKLNILLNLFNLPISEKKKKLTSTNINDIVKKESIKSIMISVEDIDMIKDEWAGKEPNVYGVGLSGLNIEESAKENKFKFQDLKILNVLINLLDNVGIKFEFKDRNDIIKNLELLDNLYLFLIYQKESNNKDSSIDLFIAKNESLNIENLKLKLKEFLLGAGNEFENHNSKTHSLSKKAIDEILPKLLDNNEGWNLEAIKNYDEEIKSQIEDNSSLMAKQDKKYLNDNFLKDAILPPNVKVTFQQAILIFNKIIQKFSKDFEIDKVVIELAREMTQDQENDALKGIAKAQKSKKSLVEERLEANNIDKSVFNDKYEKLIYKIFLWISQDFKDPYTGAQISVNEIVNNKVEIDHIIPYSLCFDDSSANKVLVHKQSNQEKSNSLPYEYIKQGHSGWNWDEFTKYVKRVFVNNVDSILSKKERLKKSENLLTASYDGYDKLGFLARNLNDTRYATILFRDQLNNYAEHHLIDNKKMFKVIAMNGAVTSFIRKNMSYDNKLRLKDRSDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIATKTDEDGITNYYKKEKFSILDDKDIYLRLLREREKFVINQSNPEVIDQIIEIIESYGKENNIPSRDEAINIKYTKNKINYNLYLKQYMRSLTKSLDQFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNQDTSKTPKRLMFGIKSIMNNYEQVDISPFGINKKIFE

SEQ ID NO: 359 - protein, 1119 aa, Lactobacillus coryniformis
MGYRIGLDVGITSTGYAVLKTDKNGLPYKILTLDSVIYPRAENPQTGASLAEPRRIKRGLRRRTRRTKFRKQRTQQLFIHSGLLSKPEIEQILATPQAKYSVYELRVAGLDRRLTNSELFRVLYFFIGHRGFKSNRKAELNPENEADKKQMGQLLNSIEEIRKAIAEKGYRTVGELYLKDPKYNDHKRNKGYIDGYLSTPNRQMLVDEIKQILDKQRELGNEKLTDEFYATYLLGDENRAGIFQAQRDFDEGPGAGPYAGDQIKKMVGKDIFEPTEDRAAKATYTFQYFNLLQKMTSLNYQNTTGDTWHTLNGLDRQAIIDAVFAKAEKPTKTYKPTDFGELRKLLKLPDDARFNLVNYGSLQTQKEIETVEKKTRFVDFKAYHDLVKVLPEEMWQSRQLLDHIGTALTLYSSDKRRRRYFAEELNLPAELIEKLLPLNFSKFGHLSIKSMQNIIPYLEMGQVYSEATTNTGYDFRKKQISKDTIREEITNPVVRRAVTKTIKIVEQIIRRYGKPDGINIELARELGRNFKERGDIQKRQDKNRQTNDKIAAELTELGIPVNGQNIIRYKLHKEQNGVDPYTGDQIPFERAFSEGYEVDHIIPYSISWDDSYTNKVLTSAKCNREKGNRIPMVYLANNEQRLNALTNIADNIIRNSRKRQKLLKQKLSDEELKDWKQRNINDTRFITRVLYNYFRQAIEFNPELEKKQRVLPLNGEVTSKIRSRWGFLKVREDGDLHHAIDATVIAAITPKFIQQVTKYSQHQEVKNNQALWHDAEIKDAEYAAEAQRMDADLFNKIFNGFPLPWPEFLDELLARISDNPVEMMKSRSWNTYTPIEIAKLKPVFVVRLANHKISGPAHLDTIRSAKLFDEKGIVLSRVSITKLKINKKGQVATGDGIYDPENSNNGDKVVYSAIRQALEAHNGSGELAFPDGYLEYVDHGTKKLVRKVRVAKKVSLPVRLKNKAAADNGSMVRIDVFNTGKKFVFVPIYIKDTVEQVLPNKAIARGKSLWYQITESDQFCFSLYPGDMVHIESKTGIKPKYSNKENNTSVVPIKNFYGYFDGADIATASILVRAHDSSYTARSIGIAGLLKFEKYQVDYFGRYHKVHEKKRQLFVKRDE

SEQ ID NO: 360 - protein, 1195 aa, Elusimicrobium minutum
MQKNINTKQNHIYIKQAQKIKEKLGDKPYRIGLDLGVGSIGFAIVSMEENDGNVLLPKEIIMVGSRIFKASAGAADRKLSRGQRNNHRHTRERMRYLWKVLAEQKLALPVPADLDRKENSSEGETSAKRFLGDVLQKDIYELRVKSLDERLSLQELGYVLYHIAGHRGSSAIRTFENDSEEAQKENTENKKIAGNIKRLMAKKNYRTYGEYLYKEFFENKEKHKREKISNAANNHKFSPTRDLVIKEAEAILKKQAGKDGFHKELTEEYIEKLTKAIGYESEKLIPESGFCPYLKDEKRLPASHKLNEERRLWETLNNARYSDPIVDIVTGEITGYYEKQFTKEQKQKLFDYLLTGSELTPAQTKKLLGLKNTNFEDIILQGRDKKAQKIKGYKLIKLESMPFWARLSEAQQDSFLYDWNSCPDEKLLTEKLSNEYHLTEEEIDNAFNEIVLSSSYAPLGKSAMLIILEKIKNDLSYTEAVEEALKEGKLTKEKQAIKDRLPYYGAVLQESTQKIIAKGFSPQFKDKGYKTPHTNKYELEYGRIANPVVHQTLNELRKLVNEIIDILGKKPCEIGLETARELKKSAEDRSKLSREQNDNESNRNRIYEIYIRPQQQVIITRRENPRNYILKFELLEEQKSQCPFCGGQISPNDIINNQADIEHLFPIAESEDNGRNNLVISHSACNADKAKRSPWAAFASAAKDSKYDYNRILSNVKENIPHKAWRFNQGAFEKFIENKPMAARFKTDNSYISKVAHKYLACLFEKPNIICVKGSLTAQLRMAWGLQGLMIPFAKQLITEKESESFNKDVNSNKKIRLDNRHHALDAIVIAYASRGYGNLLNKMAGKDYKINYSERNWLSKILLPPNNIVWENIDADLESFESSVKTALKNAFISVKHDHSDNGELVKGTMYKIFYSERGYTLTTYKKLSALKLTDPQKKKTPKDFLETALLKFKGRESEMKNEKIKSAIENNKRLFDVIQDNLEKAKKLLEEENEKSKAEGKKEKNINDASIYQKAISLSGDKYVQLSKKEPGKFFAISKPTPTTTGYGYDTGDSLCVDLYYDNKGKLCGEIIRKIDAQQKNPLKYKEQGFTLFERIYGGDILEVDFDIHSDKNSFRNNTGSAPENRVFIKVGTFTEITNNNIQIWFGNIIKSTGGQDDSFTINSMQQYNPRKLILSSCGFIKYRSPILKNKEG

SEQ ID NO: 361 - skipped

SEQ ID NO: 362 - protein, 1056 aa, Pasteurella multocida
MQTTNLSYILGLDLGIASVGWAVVEINENEDPIGLIDVGVRIFERAEVPKTGESLALSRRLARSTRRLIRRRAHRLLLAKRFLKREGILSTIDLEKGLPNQAWELRVAGLERRLSAIEWGAVLLHLIKHRGYLSKRKNESQTNNKELGALLSGVAQNHQLLQSDDYRTPAELALKKFAKEEGHIRNQRGAYTHTFNRLDLLAELNLLFAQQHQFGNPHCKEHIQQYMTELLMWQKPALSGEAILKMLGKCTHEKNEFKAAKHTYSAERFVWLTKLNNLRILEDGAERALNEEERQLLINHPYEKSKLTYAQVRKLLGLSEQAIFKHLRYSKENAESATFMELKAWHAIRKALENQGLKDTWQDLAKKPDLLDEIGTAFSLYKTDEDIQQYLTNKVPNSVINALLVSLNFDKFIELSLKSLRKILPLMEQGKRYDQACREIYGHHYGEANQKTSQLLPAIPAQEIRNPVVLRTLSQARKVINAIIRQYGSPARVHIETGRELGKSFKERREIQKQQEDNRTKRESAVQKFKELFSDFSSEPKSKDILKFRLYEQQHGKCLYSGKEINIHRLNEKGYVEIDHALPFSRTWDDSFNNKVLVLASENQNKGNQTPYEWLQGKINSERWKNFVALVLGSQCSAAKKQRLLTQVIDDNKFIDRNLNDTRYIARFLSNYIQENLLLVGKNKKNVFTPNGQITALLRSRWGLIKARENNNRHHALDAIVVACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYAGLKARLAEFNQDPAKAFATPFYKQGGQQVKAIRVEQVQKSGVLVRENNGVADNASIVRTDVFIKNNKFFLVPIYTWQVAKGILPNKAIVAHKNEDEWEEMDEGAKFKFSLFPNDLVELKTKKEYFFGYYIGLDRATGNISLKEHDGEISKGKDGVYRVGVKLALSFEKYQVDELGKNRQICRPQQRQPVR

SEQ ID NO: 363 - protein, 1059 aa, Rhodovulum sp. PH10
MGIRFAFDLGTNSIGWAVWRTGPGVFGEDTAASLDGSGVLIFKDGRNPKDGQSLATMRRVPRQSRKRRDRFVLRRRDLLAALRKAGLFPVDVEEGRRLAATDPYHLRAKALDESLTPHEMGRVIFHLNQRRGFRSNRKADRQDREKGKIAEGSKRLAETLAATNCRTLGEFLWSRHRGTPRTRSPTRIRMEGEGAKALYAFYPTREMVRAEFERLWTAQSRFAPDLLTPERHEEIAGILFRQRDLAPPKIGCCTFEPSERRLPRALPSVEARGIYERLAHLRITTGPVSDRGLTRPERDVLASALLAGKSLTFKAVRKTLKILPHALVNFEEAGEKGLDGALTAKLLSKPDHYGAAWHGLSFAEKDTFVGKLLDEADEERLIRRLVTENRLSEDAARRCASIPLADGYGRLGRTANTEILAALVEETDETGTVVTYAEAVRRAGERTGRNWHHSDERDGVILDRLPYYGEILQRHVVPGSGEPEEKNEAARWGRLANPTVHIGLNQLRKVVNRLIAAHGRPDQIVVELARELKLNREQKERLDRENRKNREENERRTAILAEHGQRDTAENKIRLRLFEEQARANAGIALCPYTGRAIGIAELFTSEVEIDHILPVSLTLDDSLANRVLCRREANREKRRQTPFQAFGATPAWNDIVARAAKLPPNKRWRFDPAALERFEREGGFLGRQLNETKYLSRLAKIYLGKICDPDRVYVTPGTLTGLLRARWGLNSILSDSNFKNRSDHRHHAVDAVVIGVLTRGMIQRIAHDAARAEDQDLDRVFRDVPVPFEDFRDHVRERVSTITVAVKPEHGKGGALHEDTSYGLVPDTDPNAALGNLVVRKPIRSLTAGEVDRVRDRALRARLGALAAPFRDESGRVRDAKGLAQALEAFGAENGIRRVRILKPDASVVTIADRRTGVPYRAVAPGENHHVDIVQMRDGSWRGFAASVFEVNRPGWRPEWEVKKLGGKLVMRLHKGDMVELSDKDGQRRVKVVQQIEISANRVRLSPHNDGGKLQDRHADADDPFRWDLATIPLLKDRGCVAVRVDPIGVVTLRRSNV

SEQ ID NO: 364 - protein, 1096 aa, Eubacterium dolichum
MMEVFMGRLVLGLDIGITSVGFGIIDLDESEIVDYGVRLFKEGTAAENETRRTKRGGRRLKRRRVTRREDMLHLLKQAGIISTSFHPLNNPYDVRVKGLNERLNGEELATALLHLCKHRGSSVETIEDDEAKAKEAGETKKVLSMNDQLLKSGKYVCEIQKERLRTNGHIRGHENNFKTRAYVDEAFQILSHQDLSNELKSAIITIISRKRMYYDGPGGPLSPTPYGRYTYFGQKEPIDLIEKMRGKCSLFPNEPRAPKLAYSAELFNLLNDLNNLSIEGEKLTSEQKAMILKIVHEKGKITPKQLAKEVGVSLEQIRGFRIDTKGSPLLSELTGYKMIREVLEKSNDEHLEDHVFYDEIAEILTKTKDIEGRKKQISELSSDLNEESVHQLAGLTKFTAYHSLSFKALRLINEEMLKTELNQMQSITLFGLKQNNELSVKGMKNIQADDTAILSPVAKRAQRETFKVVNRLREIYGEFDSIVVEMAREKNSEEQRKAIRERQKFFEMRNKQVADIIGDDRKINAKLREKLVLYQEQDGKTAYSLEPIDLKLLIDDPNAYEVDHIIPISISLDDSITNKVLVTHRENQEKGNLTPISAFVKGRFTKGSLAQYKAYCLKLKEKNIKTNKGYRKKVEQYLLNENDIYKYDIQKEFINRNLVDTSYASRVVLNTLTTYFKQNEIPTKVFTVKGSLTNAFRRKINLKKDRDEDYGHHAIDALIIASMPKMRLLSTIFSRYKIEDIYDESTGEVFSSGDDSMYYDDRYFAFIASLKAIKVRKFSHKIDTKPNRSVADETIYSTRVIDGKEKVVKKYKDIYDPKFTALAEDILNNAYQEKYLMALHDPQTFDQIVKVVNYYFEEMSKSEKYFTKDKKGRIKISGMNPLSLYRDEHGMLKKYSKKGDGPAITQMKYFDGVLGNHIDISAHYQVRDKKVVLQQISPYRTDFYYSKENGYKFVTIRYKDVRWSEKKKKYVIDQQDYAMKKAEKKIDDTYEFQFSMHRDELIGITKAEGEALIYPDETWHNFNFFFHAGETPEILKFTATNNDKSNKIEVKPIHCYCKMRLMPTISKKIVRIDKYATDVVGNLYKVKKNTLKFEFD

SEQ ID NO: 365 - protein, 1132 aa, Nitratifractor salsuginis
MKKILGVDLGITSFGYAILQETGKDLYRCLDNSVVMRNNPYDEKSGESSQSIRSTQKSMRRLIEKRKKRIRCVAQTMERYGILDYSETMKINDPKNNPIKNRWQLRAVDAWKRPLSPQELFAIFAHMAKHRGYKSIATEDLIYELELELGLNDPEKESEKKADERRQVYNALRHLEELRKKYGGETIAQTIHRAVEAGDLRSYRNHDDYEKMIRREDIEEEIEKVLLRQAELGALGLPEEQVSELIDELKACITDQEMPTIDESLFGKCTFYKDELAAPAYSYLYDLYRLYKKLADLNIDGYEVTQEDREKVIEWVEKKIAQGKNLKKITHKDLRKILGLAPEQKIFGVEDERIVKGKKEPRTFVPFFFLADIAKFKELFASIQKHPDALQIFRELAEILQRSKTPQEALDRLRALMAGKGIDTDDRELLELFKNKRSGTRELSHRYILEALPLFLEGYDEKEVQRILGFDDREDYSRYPKSLRHLHLREGNLFEKEENPINNHAVKSLASWALGLIADLSWRYGPFDEIILETTRDALPEKIRKEIDKAMREREKALDKIIGKYKKEFPSIDKRLARKIQLWERQKGLDLYSGKVINLSQLLDGSADIEHIVPQSLGGLSTDYNTIVTLKSVNAAKGNRLPGDWLAGNPDYRERIGMLSEKGLIDWKKRKNLLAQSLDEIYTENTHSKGIRATSYLEALVAQVLKRYYPFPDPELRKNGIGVRMIPGKVTSKTRSLLGIKSKSRETNFHHAEDALILSTLTRGWQNRLHRMLRDNYGKSEAELKELWKKYMPHIEGLTLADYIDEAFRRFMSKGEESLFYRDMFDTIRSISYWVDKKPLSASSHKETVYSSRHEVPTLRKNILEAFDSLNVIKDRHKLTTEEFMKRYDKEIRQKLWLHRIGNTNDESYRAVEERATQIAQILTRYQLMDAQNDKEIDEKFQQALKELITSPIEVTGKLLRKMRFVYDKLNAMQIDRGLVETDKNMLGIHISKGPNEKLIFRRMDVNNAHELQKERSGILCYLNEMLFIFNKKGLIHYGCLRSYLEKGQGSKYIALFNPRFPANPKAQPSKFTSDSKIKQVGIGSATGIIKAHLDLDGHVRSYEVFGTLPEGSIEWFKEESGYGRVEDDPHH

SEQ ID NO: 366 - protein, 1173 aa, Rhodospirillum rubrum
MRPIEPWILGLDIGTDSLGWAVFSCEEKGPPTAKELLGGGVRLFDSGRDAKDHTSRQAERGAFRRARRQTRTWPWRRDRLIALFQAAGLTPPAAETRQIALALRREAVSRPLAPDALWAALLHLAHHRGFRSNRIDKRERAAAKALAKAKPAKATAKATAPAKEADDEAGFWEGAEAALRQRMAASGAPTVGALLADDLDRGQPVRMRYNQSDRDGVVAPTRALIAEELAEIVARQSSAYPGLDWPAVTRLVLDQRPLRSKGAGPCAFLPGEDRALRALPTVQDFIIRQTLANLRLPSTSADEPRPLTDEEHAKALALLSTARFVEWPALRRALGLKRGVKFTAETERNGAKQAARGTAGNLTEAILAPLIPGWSGWDLDRKDRVFSDLWAARQDRSALLALIGDPRGPTRVTEDETAEAVADAIQIVLPTGRASLSAKAARAIAQAMAPGIGYDEAVTLALGLHHSHRPRQERLARLPYYAAALPDVGLDGDPVGPPPAEDDGAAAEAYYGRIGNISVHIALNETRKIVNALLHRHGPILRLVMVETTRELKAGADERKRMIAEQAERERENAEIDVELRKSDRWMANARERRQRVRLARRQNNLCPYTSTPIGHADLLGDAYDIDHVIPLARGGRDSLDNMVLCQSDANKTKGDKTPWEAFHDKPGWIAQRDDFLARLDPQTAKALAWRFADDAGERVARKSAEDEDQGFLPRQLTDTGYIARVALRYLSLVTNEPNAVVATNGRLTGLLRLAWDITPGPAPRDLLPTPRDALRDDTAARRFLDGLTPPPLAKAVEGAVQARLAALGRSRVADAGLADALGLTLASLGGGGKNRADHRHHFIDAAMIAVTTRGLINQINQASGAGRILDLRKWPRTNFEPPYPTFRAEVMKQWDHIHPSIRPAHRDGGSLHAATVFGVRNRPDARVLVQRKPVEKLFLDANAKPLPADKIAEIIDGFASPRMAKRFKALLARYQAAHPEVPPALAALAVARDPAFGPRGMTANTVIAGRSDGDGEDAGLITPFRANPKAAVRTMGNAVYEVWEIQVKGRPRWTHRVLTRFDRTQPAPPPPPENARLVMRLRRGDLVYWPLESGDRLFLVKKMAVDGRLALWPARLATGKATALYAQLSCPNINLNGDQGYCVQSAEGIRKEKIRTTSCTALGRLRLSKKAT

SEQ ID NO: 367 - protein, 1021 aa, Clostridium cellulolyticum
MKYTLGLDVGIASVGWAVIDKDNNKIIDLGVRCFDKAEESKTGESLATARRIARGMRRRISRRSQRLRLVKKLFVQYEIIKDSSEFNRIFDTSRDGWKDPWELRYNALSRILKPYELVQVLTHITKRRGFKSNRKEDLSTTKEGVVITSIKNNSEMLRTKNYRTIGEMIFMETPENSNKRNKVDEYIHTIAREDLLNEIKYIFSIQRKLGSPFVTEKLEHDFLNIWEFQRPFASGDSILSKVGKCTLLKEELRAPTSCYTSEYFGLLQSINNLVLVEDNNTLTLNNDQRAKIIEYAHFKNEIKYSEIRKLLDIEPEILFKAHNLTHKNPSGNNESKKFYEMKSYHKLKSTLPTDIWGKLHSNKESLDNLFYCLTVYKNDNEIKDYLQANNLDYLIEYIAKLPTFNKFKHLSLVAMKRIIPFMEKGYKYSDACNMAELDFTGSSKLEKCNKLTVEPIIENVTNPVVIRALTQARKVINAIIQKYGLPYMVNIELAREAGMTRQDRDNLKKEHENNRKAREKISDLIRQNGRVASGLDILKWRLWEDQGGRCAYSGKPIPVCDLLNDSLTQIDHIYPYSRSMDDSYMNKVLVLTDENQNKRSYTPYEVWGSTEKWEDFEARIYSMHLPQSKEKRLLNRNFITKDLDSFISRNLNDTRYISRFLKNYIESYLQFSNDSPKSCVVCVNGQCTAQLRSRWGLNKNREESDLHHALDAAVIACADRKIIKEITNYYNERENHNYKVKYPLPWHSFRQDLMETLAGVFISRAPRRKITGPAHDETIRSPKHFNKGLTSVKIPLTTVTLEKLETMVKNTKGGISDKAVYNVLKNRLIEHNNKPLKAFAEKIYKPLKNGTNGAIIRSIRVETPSYTGVFRNEGKGISDNSLMVRVDVFKKKDKYYLVPIYVAHMIKKELPSKAIVPLKPESQWELIDSTHEFLFSLYQNDYLVIKTKKGITEGYYRSCHRGTGSLSLMPHFANNKNVKIDIGVRTAISIEKYNVDILGNKSIVKGEPRRGMEKYNSFKSN

SEQ ID NO: 368 - protein, 1024 aa, Helicobacter mustelae
MIRTLGIDIGIASIGWAVIEGEYTDKGLENKEIVASGVRVFTKAENPKNKESLALPRTLARSARRRNARKKGRIQQVKHYLSKALGLDLECFVQGEKLATLFQTSKDFLSPWELRERALYRVLDKEELARVILHIAKRRGYDDITYGVEDNDSGKIKKAIAENSKRIKEEQCKTIGEMMYKLYFQKSLNVRNKKESYNRCVGRSELREELKTIFQIQQELKSPWVNEELIYKLLGNPDAQSKQEREGLIFYQRPLKGFGDKIGKCSHIKKGENSPYRACKHAPSAEEFVALTKSINFLKNLTNRHGLCFSQEDMCVYLGKILQEAQKNEKGLTYSKLKLLLDLPSDFEFLGLDYSGKNPEKAVFLSLPSTFKLNKITQDRKTQDKIANILGANKDWEAILKELESLQLSKEQIQTIKDAKLNFSKHINLSLEALYHLLPLMREGKRYDEGVEILQERGIFSKPQPKNRQLLPPLSELAKEESYFDIPNPVLRRALSEFRKVVNALLEKYGGFHYFHIELTRDVCKAKSARMQLEKINKKNKSENDAASQLLEVLGLPNTYNNRLKCKLWKQQEEYCLYSGEKITIDHLKDQRALQIDHAFPLSRSLDDSQSNKVLCLTSSNQEKSNKTPYEWLGSDEKKWDMYVGRVYSSNFSPSKKRKLTQKNFKERNEEDFLARNLVDTGYIGRVTKEYIKHSLSFLPLPDGKKEHIRIISGSMTSTMRSFWGVQEKNRDHHLHHAQDAIIIACIEPSMIQKYTTYLKDKETHRLKSHQKAQILREGDHKLSLRWPMSNFKDKIQESIQNIIPSHHVSHKVTGELHQETVRTKEFYYQAFGGEEGVKKALKFGKIREINQGIVDNGAMVRVDIFKSKDKGKFYAVPIYTYDFAIGKLPNKAIVQGKKNGIIKDWLEMDENYEFCFSLFKNDCIKIQTKEMQEAVLAIYKSTNSAKATIELEHLSKYALKNEDEEKMFTDTDKEKNKTMTRESCGIQGLKVFQKVKLSVLGEVLEHKPRNRQNIALKTTPKHV

SEQ ID NO: 369 - protein, 1092 aa, Ilyobacter polytropus
MKYSIGLDIGIASVGWSVINKDKERIEDMGVRIFQKAENPKDGSSLASSRREKRGSRRRNRRKKHRLDRIKNILCESGLVKKNEIEKIYKNAYLKSPWELRAKSLEAKISNKEIAQILLHIAKRRGFKSFRKTDRNADDTGKLLSGIQENKKIMEEKGYLTIGDMVAKDPKFNTHVRNKAGSYLFSFSRKLLEDEVRKIQAKQKELGNTHFTDDVLEKYIEVFNSQRNFDEGPSKPSPYYSEIGQIAKMIGNCTFESSEKRTAKNTWSGERFVFLQKLNNFRIVGLSGKRPLTEEERDIVEKEVYLKKEVRYEKLRKILYLKEEERFGDLNYSKDEKQDKKTEKTKFISLIGNYTIKKLNLSEKLKSEIEEDKSKLDKIIEILTFNKSDKTIESNLKKLELSREDIEILLSEEFSGTLNLSLKAIKKILPYLEKGLSYNEACEKADYDYKNNGIKFKRGELLPVVDKDLIANPVVLRAISQTRKVVNAIIRKYGTPHTIHVEVARDLAKSYDDRQTIIKENKKRELENEKTKKFISEEFGIKNVKGKLLLKYRLYQEQEGRCAYSRKELSLSEVILDESMTDIDHIIPYSRSMDDSYSNKVLVLSGENRKKSNLLPKEYFDRQGRDWDTFVLNVKAMKIHPRKKSNLLKEKFTREDNKDWKSRALNDTRYISRFVANYLENALEYRDDSPKKRVFMIPGQLTAQLRARWRLNKVRENGDLHHALDAAVVAVTDQKAINNISNISRYKELKNCKDVIPSIEYHADEETGEVYFEEVKDTRFPMPWSGFDLELQKRLESENPREEFYNLLSDKRYLGWFNYEEGFIEKLRPVFVSRMPNRGVKGQAHQETIRSSKKISNQIAVSKKPLNSIKLKDLEKMQGRDTDRKLYEALKNRLEEYDDKPEKAFAEPFYKPTNSGKRGPLVRGIKVEEKQNVGVYVNGGQASNGSMVRIDVFRKNGKFYTVPIYVHQTLLKELPNRAINGKPYKDWDLIDGSFEFLYSFYPNDLIEIEFGKSKSIKNDNKLTKTEIPEVNLSEVLGYYRGMDTSTGAATIDTQDGKIQMRIGIKTVKNIKKYQVDVLGNVYKVKREKRQTF

SEQ ID NO: 370 - protein, 1179 aa, Sphaerochaeta globus
MSKKVSRRYEEQAQEICQRLGSRPYSIGLDLGVGSIGVAVAAYDPIKKQPSDLVFVSSRIFIPSTGAAERRQKRGQRNSLRHRANRLKFLWKLLAERNLMLSYSEQDVPDPARLRFEDAVVRANPYELRLKGLNEQLTLSELGYALYHIANHRGSSSVRTFLDEEKSSDDKKLEEQQAMTEQLAKEKGISTFIEVLTAFNTNGLIGYRNSESVKSKGVPVPTRDIISNEIDVLLQTQKQFYQEILSDEYCDRIVSAILFENEKIVPEAGCCPYFPDEKKLPRCHFLNEERRLWEAINNARIKMPMQEGAAKRYQSASFSDEQRHILFHIARSGTDITPKLVQKEFPALKTSIIVLQGKEKAIQKIAGFRFRRLEEKSFWKRLSEEQKDDFFSAWTNTPDDKRLSKYLMKHLLLTENEVVDALKTVSLIGDYGPIGKTATQLLMKHLEDGLTYTEALERGMETGEFQELSVWEQQSLLPYYGQILTGSTQALMGKYWHSAFKEKRDSEGFFKPNTNSDEEKYGRIANPVVHQTLNELRKLMNELITILGAKPQEITVELARELKVGAEKREDIIKQQTKQEKEAVLAYSKYCEPNNLDKRYIERFRLLEDQAFVCPYCLEHISVADIAAGRADVDHIFPRDDTADNSYGNKVVAHRQCNDIKGKRTPYAAFSNTSAWGPIMHYLDETPGMWRKRRKFETNEEEYAKYLQSKGFVSRFESDNSYIAKAAKEYLRCLFNPNNVTAVGSLKGMETSILRKAWNLQGIDDLLGSRHWSKDADTSPTMRKNRDDNRHHGLDAIVALYCSRSLVQMINTMSEQGKRAVEIEAMIPIPGYASEPNLSFEAQRELFRKKILEFMDLHAFVSMKTDNDANGALLKDTVYSILGADTQGEDLVFVVKKKIKDIGVKIGDYEEVASAIRGRITDKQPKWYPMEMKDKIEQLQSKNEAALQKYKESLVQAAAVLEESNRKLIESGKKPIQLSEKTISKKALELVGGYYYLISNNKRTKTFVVKEPSNEVKGFAFDTGSNLCLDFYHDAQGKLCGEIIRKIQAMNPSYKPAYMKQGYSLYVRLYQGDVCELRASDLTEAESNLAKTTHVRLPNAKPGRTFVIIITFTEMGSGYQIYFSNLAKSKKGQDTSFTLTTIKNYDVRKVQLSSAGLVRYVSPLLVDKIEKDEVALCGE

SEQ ID NO: 371 - protein, 1054 aa, Staphylococcus lugdunensis
MNQKFILGLDIGITSVGYGLIDYETKNIIDAGVRLFPEANVENNEGRRSKRGSRRLKRRRIHRLERVKKLLEDYNLLDQSQIPQSTNPYAIRVKGLSEALSKDELVIALLHIAKRRGIHKIDVIDSNDDVGNELSTKEQLNKNSKLLKDKFVCQIQLERMNEGQVRGEKNRFKTADIIKEIIQLLNVQKNFHQLDENFINKYIELVEMRREYFEGPGKGSPYGWEGDPKAWYETLMGHCTYFPDELRSVKYAYSADLFNALNDLNNLVIQRDGLSKLEYHEKYHIIENVFKQKKKPTLKQIANEINVNPEDIKGYRITKSGKPQFTEFKLYHDLKSVLFDQSILENEDVLDQIAEILTIYQDKDSIKSKLTELDILLNEEDKENIAQLTGYTGTHRLSLKCIRLVLEEQWYSSRNQMEIFTHLNIKPKKINLTAANKIPKAMIDEFILSPVVKRTFGQAINLINKIIEKYGVPEDIIIELARENNSKDKQKFINEMQKKNENTRKRINEIIGKYGNQNAKRLVEKIRLHDEQEGKCLYSLESIPLEDLLNNPNHYEVDHIIPRSVSFDNSYHNKVLVKQSENSKKSNLTPYQYFNSGKSKLSYNQFKQHILNLSKSQDRISKKKKEYLLEERDINKFEVQKEFINRNLVDTRYATRELTNYLKAYFSANNMNVKVKTINGSFTDYLRKVWKFKKERNHGYKHHAEDALIIANADFLFKENKKLKAVNSVLEKPEIESKQLDIQVDSEDNYSEMFIIPKQVQDIKDFRNFKYSHRVDKKPNRQLINDTLYSTRKKDNSTYIVQTIKDIYAKDNTTLKKQFDKSPEKFLMYQHDPRTFEKLEVIMKQYANEKNPLAKYHEETGEYLTKYSKKNNGPIVKSLKYIGNKLGSHLDVTHQFKSSTKKLVKLSIKPYRFDVYLTDKGYKFITISYLDVLKKDNYYYIPEQKYDKLKLGKAIDKNAKFIASFYKNDLIKLDGEIYKIIGVNSDTRNMIELDLPDIRYKEYCELNNIKGEPRIKKTIGKKVNSIEKLTTDVLGNVFTNTQYTKPQLLFKRGN

SEQ ID NO: 372 - protein, 1061 aa, Treponema sp. JC4
MIMKLEKWRLGLDLGTNSIGWSVFSLDKDNSVQDLIDMGVRIFSDGRDPKTKEPLAVARRTARSQRKLIYRRKLRRKQVFKFLQEQGLFPKTKEECMTLKSLNPYELRIKALDEKLEPYELGRALFNLAVRRGFKSNRKDGSREEVSEKKSPDEIKTQADMQTHLEKAIKENGCRTITEFLYKNQGENGGIRFAPGRMTYYPTRKMYEEEFNLIRSKQEKYYPQVDWDDIYKAIFYQRPLKPQQRGYCIYENDKERTFKAMPCSQKLRILQDIGNLAYYEGGSKKRVELNDNQDKVLYELLNSKDKVTFDQMRKALCLADSNSFNLEENRDFLIGNPTAVKMRSKNRFGKLWDEIPLEEQDLIIETIITADEDDAVYEVIKKYDLTQEQRDFIVKNTILQSGTSMLCKEVSEKLVKRLEEIADLKYHEAVESLGYKFADQTVEKYDLLPYYGKVLPGSTMEIDLSAPETNPEKHYGKISNPTVHVALNQTRVVVNALIKEYGKPSQIAIELSRDLKNNVEKKAEIARKQNQRAKENIAINDTISALYHTAFPGKSFYPNRNDRMKYRLWSELGLGNKCIYCGKGISGAELFTKEIEIEHILPFSRTLLDAESNLTVAHSSCNAFKAERSPFEAFGTNPSGYSWQEIIQRANQLKNTSKKNKFSPNAMDSFEKDSSFIARQLSDNQYIAKAALRYLKCLVENPSDVWTTNGSMTKLLRDKWEMDSILCRKFTEKEVALLGLKPEQIGNYKKNRFDHRHHAIDAVVIGLTDRSMVQKLATKNSHKGNRIEIPEFPILRSDLIEKVKNIVVSFKPDHGAEGKLSKETLLGKIKLHGKETFVCRENIVSLSEKNLDDIVDEIKSKVKDYVAKHKGQKIEAVLSDFSKENGIKKVRCVNRVQTPIEITSGKISRYLSPEDYFAAVIWEIPGEKKTFKAQYIRRNEVEKNSKGLNVVKPAVLENGKPHPAAKQVCLLHKDDYLEFSDKGKMYFCRIAGYAATNNKLDIRPVYAVSYCADWINSTNETMLTGYWKPTPTQNWVSVNVLFDKQKARLVTVSPIGRVFRK

SEQ ID NO: 373 - protein, 1011 aa, Deltaproteobacterium HF0070
MSSKAIDSLEQLDLFKPQEYTLGLDLGIKSIGWAILSGERIANAGVYLFETAEELNSTGNKLISKAAERGRKRRIRRMLDRKARRGRHIRYLLEREGLPTDELEEVVVHQSNRTLWDVRAEAVERKLTKQELAAVLFHLVRHRGYFPNTKKLPPDDESDSADEEQGKINRATSRLREELKASDCKTIGQFLAQNRDRQRNREGDYSNLMARKLVFEEALQILAFQRKQGHELSKDFEKTYLDVLMGQRSGRSPKLGNCSLIPSELRAPSSAPSTEWFKFLQNLGNLQISNAYREEWSIDAPRRAQIIDACSQRSTSSYWQIRRDFQIPDEYRFNLVNYERRDPDVDLQEYLQQQERKTLANFRNWKQLEKIIGTGHPIQTLDEAARLITLIKDDEKLSDQLADLLPEASDKAITQLCELDFTTAAKISLEAMYRILPHMNQGMGFFDACQQESLPEIGVPPAGDRVPPFDEMYNPVVNRVLSQSRKLINAVIDEYGMPAKIRVELARDLGKGRELRERIKLDQLDKSKQNDQRAEDFRAEFQQAPRGDQSLRYRLWKEQNCTCPYSGRMIPVNSVLSEDTQIDHILPISQSFDNSLSNKVLCFTEENAQKSNRTPFEYLDAADFQRLEAISGNWPEAKRNKLLHKSFGKVAEEWKSRALNDTRYLTSALADHLRHHLPDSKIQTVNGRITGYLRKQWGLEKDRDKHTHHAVDAIVVACTTPAIVQQVTLYHQDIRRYKKLGEKRPTPWPETFRQDVLDVEEEIFITRQPKKVSGGIQTKDTLRKHRSKPDRQRVALTKVKLADLERLVEKDASNRNLYEHLKQCLEESGDQPTKAFKAPFYMPSGPEAKQRPILSKVTLLREKPEPPKQLTELSGGRRYDSMAQGRLDIYRYKPGGKRKDEYRVVLQRMIDLMRGEENVHVFQKGVPYDQGPEIEQNYTFLFSLYFDDLVEFQRSADSEVIRGYYRTFNIANGQLKISTYLEGRQDFDFFGANRLAHFAKVQVNLLGKVIK

SEQ ID NO: 374 - protein, 1029 aa, Alicycliphilus denitrificans
MRSLRYRLALDLGSTSLGWALFRLDACNRPTAVIKAGVRIFSDGRNPKDGSSLAVTRRAARAMRRRRDRLLKRKTRMQAKLVEHGFFPADAGKRKALEQLNPYALRAKGLQEALLPGEFARALFHINQRRGFKSNRKTDKKDNDSGVLKKAIGQLRQQMAEQGSRTVGEYLWTRLQQGQGVRARYREKPYTTEEGKKRIDKSYDLYIDRAMIEQEFDALWAAQAAFNPTLFHEAARADLKDTLLHQRPLRPVKPGRCTLLPEEERAPLALPSTQRFRIHQEVNHLRLLDENLREVALTLAQRDAVVTALETKAKLSFEQIRKLLKLSGSVQFNLEDAKRTELKGNATSAALARKELFGAAWSGFDEALQDEIVWQLVTEEGEGALIAWLQTHTGVDEARAQAIVDVSLPEGYGNLSRKALARIVPALRAAVITYDKAVQAAGFDHHSQLGFEYDASEVEDLVHPETGEIRSVFKQLPYYGKALQRHVAFGSGKPEDPDEKRYGKIANPTVHIGLNQVRMVVNALIRRYGRPTEVVIELARDLKQSREQKVEAQRRQADNQRRNARIRRSIAEVLGIGEERVRGSDIQKWICWEELSFDAADRRCPYSGVQISAAMLLSDEVEVEHILPFSKTLDDSLNNRTVAMRQANRIKRNRTPWDARAEFEAQGWSYEDILQRAERMPLRKRYRFAPDGYERWLGDDKDFLARALNDTRYLSRVAAEYLRLVCPGTRVIPGQLTALLRGKFGLNDVLGLDGEKNRNDHRHHAVDACVIGVTDQGLMQRFATASAQARGDGLTRLVDGMPMPWPTYRDHVERAVRHIWVSHRPDHGFEGAMMEETSYGIRKDGSIKQRRKADGSAGREISNLIRIHEATQPLRHGVSADGQPLAYKGYVGGSNYCIEITVNDKGKWEGEVISTFRAYGVVRAGGMGRLRNPHEGQNGRKLIMRLVIGDSVRLEVDGAERTMRIVKISGSNGQIFMAPIHEANVDARNTDKQDAFTYTSKYAGSLQKAKTRRVTISPIGEVRDPGFKG

SEQ ID NO: 375 - protein, 1168 aa, Azospirillum sp. B510
MARPAFRAPRREHVNGWTPDPHRISKPFFILVSWHLLSRVVIDSSSGCFPGTSRDHTDKFAEWECAVQPYRLSFDLGTNSIGWGLLNLDRQGKPREIRALGSRIFSDGRDPQDKASLAVARRLARQMRRRRDRYLTRRTRLMGALVRFGLMPADPAARKRLEVAVDPYLARERATRERLEPFEIGRALFHLNQRRGYKPVRTATKPDEEAGKVKEAVERLEAAIAAAGAPTLGAWFAWRKTRGETLRARLAGKGKEAAYPFYPARRMLEAEFDTLWAEQARHHPDLLTAEAREILRHRIFHQRPLKPPPVGRCTLYPDDGRAPRALPSAQRLRLFQELASLRVIHLDLSERPLTPAERDRIVAFVQGRPPKAGRKPGKVQKSVPFEKLRGLLELPPGTGFSLESDKRPELLGDETGARIAPAFGPGWTALPLEEQDALVELLLTEAEPERAIAALTARWALDEATAAKLAGATLPDFHGRYGRRAVAELLPVLERETRGDPDGRVRPIRLDEAVKLLRGGKDHSDFSREGALLDALPYYGAVLERHVAFGTGNPADPEEKRVGRVANPTVHIALNQLRHLVNAILARHGRPEEIVIELARDLKRSAEDRRREDKRQADNQKRNEERKRLILSLGERPTPRNLLKLRLWEEQGPVENRRCPYSGETISMRMLLSEQVDIDHILPFSVSLDDSAANKVVCLREANRIKRNRSPWEAFGHDSERWAGILARAEALPKNKRWRFAPDALEKLEGEGGLRARHLNDTRHLSRLAVEYLRCVCPKVRVSPGRLTALLRRRWGIDAILAEADGPPPEVPAETLDPSPAEKNRADHRHHALDAVVIGCIDRSMVQRVQLAAASAEREAAAREDNIRRVLEGFKEEPWDGFRAELERRARTIVVSHRPEHGIGGALHKETAYGPVDPPEEGFNLVVRKPIDGLSKDEINSVRDPRLRRALIDRLAIRRRDANDPATALAKAAEDLAAQPASRGIRRVRVLKKESNPIRVEHGGNPSGPRSGGPFHKLLLAGEVHHVDVALRADGRRWVGHWVTLFEAHGGRGADGAAAPPRLGDGERFLMRLHKGDCLKLEHKGRVRVMQVVKLEPSSNSVVVVEPHQVKTDRSKHVKISCDQLRARGARRVTVDPLGRVRVHAPGARVGIGGDAGRTAMEPAEDIS

SEQ ID NO: 376 - protein, 1064 aa, Bradyrhizobium sp. BTAi1
MKRTSLRAYRLGVDLGANSLGWFVVWLDDHGQPEGLGPGGVRIFPDGRNPQSKQSNAAGRRLARSARRRRDRYLQRRGKLMGLLVKHGLMPADEPARKRLECLDPYGLRAKALDEVLPLHHVGRALFHLNQRRGLFANRAIEQGDKDASAIKAAAGRLQTSMQACGARTLGEFLNRRHQLRATVRARSPVGGDVQARYEFYPTRAMVDAEFEAIWAAQAPHHPTMTAEAHDTIREAIFSQRAMKRPSIGKCSLDPATSQDDVDGFRCAWSHPLAQRFRIWQDVRNLAVVETGPTSSRLGKEDQDKVARALLQTDQLSFDEIRGLLGLPSDARFNLESDRRDHLKGDATGAILSARRHFGPAWHDRSLDRQIDIVALLESALDEAAIIASLGTTHSLDEAAAQRALSALLPDGYCRLGLRAIKRVLPLMEAGRTYAEAASAAGYDHALLPGGKLSPTGYLPYYGQWLQNDVVGSDDERDTNERRWGRLPNPTVHIGIGQLRRVVNELIRWHGPPAEITVELTRDLKLSPRRLAELEREQAENQRKNDKRTSLLRKLGLPASTHNLLKLRLWDEQGDVASECPYTGEAIGLERLVSDDVDIDHLIPFSISWDDSAANKVVCMRYANREKGNRTPFEAFGHRQGRPYDWADIAERAARLPRGKRWRFGPGARAQFEELGDFQARLLNETSWLARVAKQYLAAVTHPHRIHVLPGRLTALLRATWELNDLLPGSDDRAAKSRKDHRHHAIDALVAALTDQALLRRMANAHDDTRRKIEVLLPWPTFRIDLETRLKAMLVSHKPDHGLQARLHEDTAYGTVEHPETEDGANLVYRKTFVDISEKEIDRIRDRRLRDLVRAHVAGERQQGKTLKAAVLSFAQRRDIAGHPNGIRHVRLTKSIKPDYLVPIRDKAGRIYKSYNAGENAFVDILQAESGRWIARATTVFQANQANESHDAPAAQPIMRVFKGDMLRIDHAGAEKFVKIVRLSPSNNLLYLVEHHQAGVFQTRHDDPEDSFRWLFASFDKLREWNAELVRIDTLGQPWRRKRGLETGSEDATRIGWTRPKKWP

SEQ ID NO: 377 - protein, 1037 aa, Parvibaculum lavamentivorans
MERIFGFDIGTTSIGFSVIDYSSTQSAGNIQRLGVRIFPEARDPDGTPLNQQRRQKRMMRRQLRRRRIRRKALNETLHEAGFLPAYGSADWPVVMADEPYELRRRGLEEGLSAYEFGRAIYHLAQHRHFKGRELEESDTPDPDVDDEKEAANERAATLKALKNEQTTLGAWLARRPPSDRKRGIHAHRNVVAEEFERLWEVQSKFHPALKSEEMRARISDTIFAQRPVFWRKNTLGECRFMPGEPLCPKGSWLSQQRRMLEKLNNLAIAGGNARPLDAEERDAILSKLQQQASMSWPGVRSALKALYKQRGEPGAEKSLKFNLELGGESKLLGNALEAKLADMFGPDWPAHPRKQEIRHAVHERLWAADYGETPDKKRVIILSEKDRKAHREAAANSFVADFGITGEQAAQLQALKLPTGWEPYSIPALNLFLAELEKGERFGALVNGPDWEGWRRTNFPHRNQPTGEILDKLPSPASKEERERISQLRNPTVVRTQNELRKVVNNLIGLYGKPDRIRIEVGRDVGKSKREREEIQSGIRRNEKQRKKATEDLIKNGIANPSRDDVEKWILWKEGQERCPYTGDQIGFNALFREGRYEVEHIWPRSRSFDNSPRNKTLCRKDVNIEKGNRMPFEAFGHDEDRWSAIQIRLQGMVSAKGGTGMSPGKVKRFLAKTMPEDFAARQLNDTRYAAKQILAQLKRLWPDMGPEAPVKVEAVTGQVTAQLRKLWTLNNILADDGEKTRADHRHHAIDALTVACTHPGMTNKLSRYWQLRDDPRAEKPALTPPWDTIRADAEKAVSEIVVSHRVRKKVSGPLHKETTYGDTGTDIKTKSGTYRQFVTRKKIESLSKGELDEIRDPRIKEIVAAHVAGRGGDPKKAFPPYPCVSPGGPEIRKVRLTSKQQLNLMAQTGNGYADLGSNHHIAIYRLPDGKADFEIVSLFDASRRLAQRNPIVQRTRADGASFVMSLAAGEAIMIPEGSKKGIWIVQGVWASGQVVLERDTDADHSTTTRPMPNPILKDDAKKVSIDPIGRVRPSND

SEQ ID NO: 378 - protein, 1218 aa, Prevotella timonensis
MNKRILGLDTGTNSLGWAVVDWDEHAQSYELIKYGDVIFQEGVKIEKGIESSKAAERSGYKAIRKQYFRRRLRKIQVLKVLVKYHLCPYLSDDDLRQWHLQKQYPKSDELMLWQRTSDEEGKNPYYDRHRCLHEKLDLTVEADRYTLGRALYHLTQRRGFLSNRLDTSADNKEDGVVKSGISQLSTEMEEAGCEYLGDYFYKLYDAQGNKVRIRQRYTDRNKHYQHEFDAICEKQELSSELIEDLQRAIFFQLPLKSQRHGVGRCTFERGKPRCADSHPDYEEFRMLCFVNNIQVKGPHDLELRPLTYEEREKIEPLFFRKSKPNFDFEDIAKALAGKKNYAWIHDKEERAYKFNYRMTQGVPGCPTIAQLKSIFGDDWKTGIAETYTLIQKKNGSKSLQEMVDDVWNVLYSFSSVEKLKEFAHHKLQLDEESAEKFAKIKLSHSFAALSLKAIRKFLPFLRKGMYYTHASFFANIPTIVGKEIWNKEQNRKYIMENVGELVFNYQPKHREVQGTIEMLIKDFLANNFELPAGATDKLYHPSMIETYPNAQRNEFGILQLGSPRTNAIRNPMAMRSLHILRRVVNQLLKESIIDENTEVHVEYARELNDANKRRAIADRQKEQDKQHKKYGDEIRKLYKEETGKDIEPTQTDVLKFQLWEEQNHHCLYTGEQIGITDFIGSNPKFDIEHTIPQSVGGDSTQMNLTLCDNRFNREVKKAKLPTELANHEEILTRIEPWKNKYEQLVKERDKQRTFAGMDKAVKDIRIQKRHKLQMEIDYWRGKYERFTMTEVPEGFSRRQGTGIGLISRYAGLYLKSLFHQADSRNKSNVYVVKGVATAEFRKMWGLQSEYEKKCRDNHSHHCMDAITIACIGKREYDLMAEYYRMEETFKQGRGSKPKFSKPWATFTEDVLNIYKNLLVVHDTPNNMPKHTKKYVQTSIGKVLAQGDTARGSLHLDTYYGAIERDGEIRYVVRRPLSSFTKPEELENIVDETVKRTIKEAIADKNFKQAIAEPIYMNEEKGILIKKVRCFAKSVKQPINIRQHRDLSKKEYKQQYHVMNENNYLLAIYEGLVKNKVVREFEIVSYIEAAKYYKRSQDRNIFSSIVPTHSTKYGLPLKTKLLMGQLVLMFEENPDEIQVDNTKDLVKRLYKVVGIEKDGRIKFKYHQEARKEGLPIFSTPYKNNDDYAPIFRQSINNINILVDGIDFTIDILGKVTLKE

SEQ ID NO: 379 - protein, 1088 aa, Bacillus smithii
MNYKMGLDIGIASVGWAVINLDLKRIEDLGVRIFDKAEHPQNGESLALPRRIARSARRRLRRRKHRLERIRRLLVSENVLTKEEMNLLFKQKKQIDVWQLRVDALERKLNNDELARVLLHLAKRRGFKSNRKSERNSKESSEFLKNIEENQSILAQYRSVGEMIVKDSKFAYHKRNKLDSYSNMIARDDLEREIKLIFEKQREFNNPVCTERLEEKYLNIWSSQRPFASKEDIEKKVGFCTFEPKEKRAPKATYTFQSFIVWEHINKLRLVSPDETRALTEIERNLLYKQAFSKNKMTYYDIRKLLNLSDDIHFKGLLYDPKSSLKQIENIRFLELDSYHKIRKCIENVYGKDGIRMFNETDIDTFGYALTIFKDDEDIVAYLQNEYITKNGKRVSNLANKVYDKSLIDELLNLSFSKFAHLSMKAIRNILPYMEQGEIYSKACELAGYNFTGPKKKEKALLLPVIPNIANPVVMRALTQSRKVVNAIIKKYGSPVSIHIELARDLSHSFDERKKIQKDQTENRKKNETAIKQLIEYELTKNPTGLDIVKFKLWSEQQGRCMYSLKPIELERLLEPGYVEVDHILPYSRSLDDSYANKVLVLTKENREKGNHTPVEYLGLGSERWKKFEKFVLANKQFSKKKKQNLLRLRYEETEEKEFKERNLNDTRYISKFFANFIKEHLKFADGDGGQKVYTINGKITAHLRSRWDFNKNREESDLHHAVDAVIVACATQGMIKKITEFYKAREQNKESAKKKEPIFPQPWPHFADELKARLSKFPQESIEAFALGNYDRKKLESLRPVFVSRMPKRSVTGAAHQETLRRCVGIDEQSGKIQTAVKTKLSDIKLDKDGHFPMYQKESDPRTYEAIRQRLLEHNNDPKKAFQEPLYKPKKNGEPGPVIRTVKIIDTKNKVVHLDGSKTVAYNSNIVRTDVFEKDGKYYCVPVYTMDIMKGTLPNKAIEANKPYSEWKEMTEEYTFQFSLFPNDLVRIVLPREKTIKTSTNEEIIIKDIFAYYKTIDSATGGLELISHDRNFSLRGVGSKTLKRFEKYQVDVLGNIHKVKGEKRVGLAAPTNQKKGKTVDSLQSVSD

SEQ ID NO: 380 - protein, 1035 aa, Candidatus Puniceispirillum marinum
MRRLGLDLGTNSIGWCLLDLGDDGEPVSIFRTGARIFSDGRDPKSLGSLKATRREARLTRRRRDRFIQRQKNLINALVKYGLMPADEIQRQALAYKDPYPIRKKALDEAIDPYEMGRAIFHINQRRGFKSNRKSADNEAGVVKQSIADLEMKLGEAGARTIGEFLADRQATNDTVRARRLSGTNALYEFYPDRYMLEQEFDTLWAKQAAFNPSLYIEAARERLKEIVFFQRKLKPQEVGRCIFLSDEDRISKALPSFQRFRIYQELSNLAWIDHDGVAHRITASLALRDHLFDELEHKKKLTFKAMRAILRKQGVVDYPVGFNLESDNRDHLIGNLTSCIMRDAKKMIGSAWDRLDEEEQDSFILMLQDDQKGDDEVRSILTQQYGLSDDVAEDCLDVRLPDGHGSLSKKAIDRILPVLRDQGLIYYDAVKEAGLGEANLYDPYAALSDKLDYYGKALAGHVMGASGKFEDSDEKRYGTISNPTVHIALNQVRAVVNELIRLHGKPDEVVIEIGRDLPMGADGKRELERFQKEGRAKNERARDELKKLGHIDSRESRQKFQLWEQLAKEPVDRCCPFTGKMMSISDLFSDKVEIEHLLPFSLTLDDSMANKTVCFRQANRDKGNRAPFDAFGNSPAGYDWQEILGRSQNLPYAKRWRFLPDAMKRFEADGGFLERQLNDTRYISRYTTEYISTIIPKNKIWVVTGRLTSLLRGFWGLNSILRGHNTDDGTPAKKSRDDHRHHAIDAIVVGMTSRGLLQKVSKAARRSEDLDLTRLFEGRIDPWDGFRDEVKKHIDAIIVSHRPRKKSQGALHNDTAYGIVEHAENGASTVVHRVPITSLGKQSDIEKVRDPLIKSALLNETAGLSGKSFENAVQKWCADNSIKSLRIVETVSIIPITDKEGVAYKGYKGDGNAYMDIYQDPTSSKWKGEIVSRFDANQKGFIPSWQSQFPTARLIMRLRINDLLKLQDGEIEEIYRVQRLSGSKILMAPHTEANVDARDRDKNDTFKLTSKSPGKLQSASARKVHISPTGLIREG

SEQ ID NO: 381 - protein, 1153 aa, Barnesiella intestinihominis
MKNILGLDLGLSSIGWSVIRENSEEQELVAMGSRVVSLTAAELSSFTQGNGVSINSQRTQKRTQRKGYDRYQLRRTLLRNKLDTLGMLPDDSLSYLPKLQLWGLRAKAVTQRIELNELGRVLLHLNQKRGYKSIKSDFSGDKKITDYVKTVKTRYDELKEMRLTIGELFFRRLTENAFFRCKEQVYPRQAYVEEFDCIMNCQRKFYPDILTDETIRCIRDEIIYYQRPLKSCKYLVSRCEFEKRFYLNAAGKKTEAGPKVSPRTSPLFQVCRLWESINNIVVKDRRNEIVFISAEQRAALFDFLNTHEKLKGSDLLKLLGLSKTYGYRLGEQFKTGIQGNKTRVEIERALGNYPDKKRLLQFNLQEESSSMVNTETGEIIPMISLSFEQEPLYRLWHVLYSIDDREQLQSVLRQKFGIDDDEVLERLSAIDLVKAGFGNKSSKAIRRILPFLQLGMNYAEACEAAGYNHSNNYTKAENEARALLDRLPAIKKNELRQPVVEKILNQMVNVVNALMEKYGRFDEIRVELARELKQSKEERSNTYKSINKNQRENEQIAKRIVEYGVPTRSRIQKYKMWEESKHCCIYCGQPVDVGDFLRGFDVEVEHIIPKSLYFDDSFANKVCSCRSCNKEKNNRTAYDYMKSKGEKALSDYVERVNTMYTNNQISKTKWQNLLTPVDKISIDFIDRQLRESQYIARKAKEILTSICYNVTATSGSVTSFLRHVWGWDTVLHDLNFDRYKKVGLTEVIEVNHRGSVIRREQIKDWSKRFDHRHHAIDALTIACTKQAYIQRLNNLRAEEGPDFNKMSLERYIQSQPHFSVAQVREAVDRILVSFRAGKRAVTPGKRYIRKNRKRISVQSVLIPRGALSEESVYGVIHVWEKDEQGHVIQKQRAVMKYPITSINREMLDKEKVVDKRIHRILSGRLAQYNDNPKEAFAKPVYIDKECRIPIRTVRCFAKPAINTLVPLKKDDKGNPVAWVNPGNNHHVAIYRDEDGKYKERTVTFWEAVDRCRVGIPAIVTQPDTIWDNILQRNDISENVLESLPDVKWQFVLSLQQNEMFILGMNEEDYRYAMDQQDYALLNKYLYRVQKLSKSDYSFRYHTETSVEDKYDGKPNLKLSMQMGKLKRVSIKSLLGLNPHKVHISVLGEIKEIS

SEQ ID NO: 382 - protein, 1062 aa, Ralstonia syzygii
MAEKQHRWGLDIGTNSIGWAVIALIEGRPAGLVATGSRIFSDGRNPKDGSSLAVERRGPRQMRRRRDRYLRRRDRFMQALINVGLMPGDAAARKALVTENPYVLRQRGLDQALTLPEFGRALFHLNQRRGFQSNRKTDRATAKESGKVKNAIAAFRAGMGNARTVGEALARRLEDGRPVRARMVGQGKDEHYELYIAREWIAQEFDALWASQQRFHAEVLADAARDRLRAILLFQRKLLPVPVGKCFLEPNQPRVAAALPSAQRFRLMQELNHLRVMTLADKRERPLSFQERNDLLAQLVARPKCGFDMLRKIVFGANKEAYRFTIESERRKELKGCDTAAKLAKVNALGTRWQALSLDEQDRLVCLLLDGENDAVLADALREHYGLTDAQIDTLLGLSFEDGHMRLGRSALLRVLDALESGRDEQGLPLSYDKAVVAAGYPAHTADLENGERDALPYYGELLWRYTQDAPTAKNDAERKFGKIANPTVHIGLNQLRKLVNALIQRYGKPAQIVVELARNLKAGLEEKERIKKQQTANLERNERIRQKLQDAGVPDNRENRLRMRLFEELGQGNGLGTPCIYSGRQISLQRLFSNDVQVDHILPFSKTLDDSFANKVLAQHDANRYKGNRGPFEAFGANRDGYAWDDIRARAAVLPRNKRNRFAETAMQDWLHNETDFLARQLTDTAYLSRVARQYLTAICSKDDVYVSPGRLTAMLRAKWGLNRVLDGVMEEQGRPAVKNRDDHRHHAIDAVVIGATDRAMLQQVATLAARAREQDAERLIGDMPTPWPNFLEDVRAAVARCVVSHKPDHGPEGGLHNDTAYGIVAGPFEDGRYRVRHRVSLFDLKPGDLSNVRCDAPLQAELEPIFEQDDARAREVALTALAERYRQRKVWLEELMSVLPIRPRGEDGKTLPDSAPYKAYKGDSNYCYELFINERGRWDGELISTFRANQAAYRRFRNDPARFRRYTAGGRPLLMRLCINDYIAVGTAAERTIFRVVKMSENKITLAEHFEGGTLKQRDADKDDPFKYLTKSPGALRDLGARRIFVDLIGRVLDPGIKGD

SEQ ID NO: 383 - protein, 1059 aa, Wolinella succinogenes
MIERILGVDLGISSLGWAIVEYDKDDEAANRIIDCGVRLFTAAETPKKKESPNKARREARGIRRVLNRRRVRMNMIKKLFLRAGLIQDVDLDGEGGMFYSKANRADVWELRHDGLYRLLKGDELARVLIHIAKHRGYKFIGDDEADEESGKVKKAGVVLRQNFEAAGCRTVGEWLWRERGANGKKRNKHGDYEISIHRDLLVEEVEAIFVAQQEMRSTIATDALKAAYREIAFFVRPMQRIEKMVGHCTYFPEERRAPKSAPTAEKFIAISKFFSTVIIDNEGWEQKIIERKTLEELLDFAVSREKVEFRHLRKFLDLSDNEIFKGLHYKGKPKTAKKREATLFDPNEPTELEFDKVEAEKKAWISLRGAAKLREALGNEFYGRFVALGKHADEATKILTYYKDEGQKRRELTKLPLEAEMVERLVKIGFSDFLKLSLKAIRDILPAMESGARYDEAVLMLGVPHKEKSAILPPLNKTDIDILNPTVIRAFAQFRKVANALVRKYGAFDRVHFELAREINTKGEIEDIKESQRKNEKERKEAADWIAETSFQVPLTRKNILKKRLYIQQDGRCAYTGDVIELERLFDEGYCEIDHILPRSRSADDSFANKVLCLARANQQKTDRTPYEWFGHDAARWNAFETRTSAPSNRVRTGKGKIDRLLKKNFDENSEMAFKDRNLNDTRYMARAIKTYCEQYWVFKNSHTKAPVQVRSGKLTSVLRYQWGLESKDRESHTHHAVDAIIIAFSTQGMVQKLSEYYRFKETHREKERPKLAVPLANFRDAVEEATRIENTETVKEGVEVKRLLISRPPRARVTGQAHEQTAKPYPRIKQVKNKKKWRLAPIDEEKFESFKADRVASANQKNFYETSTIPRVDVYHKKGKFHLVPIYLHEMVLNELPNLSLGTNPEAMDENFFKFSIFKDDLISIQTQGTPKKPAKIIMGYFKNMHGANMVLSSINNSPCEGFTCTPVSMDKKHKDKCKLCPEENRIAGRCLQGFLDYWSQEGLRPPRKEFECDQGVKFALDVKKYQIDPLGYYYEVKQEKRLGTIPQMRSAKKLVKK

SEQ ID NO: 384 - protein, 1269 aa, Mycoplasma gallisepticum
MNNSIKSKPEVTIGLDLGVGSVGWAIVDNETNIIHHLGSRLFSQAKTAEDRRSFRGVRRLIRRRKYKLKRFVNLIWKYNSYFGFKNKEDILNNYQEQQKLHNTVLNLKSEALNAKIDPKALSWILHDYLKNRGHFYEDNRDFNVYPTKELAKYFDKYGYYKGIIDSKEDNDNKLEEELTKYKFSNKHWLEEVKKVLSNQTGLPEKFKEEYESLFSYVRNYSEGPGSINSVSPYGIYHLDEKEGKVVQKYNNIWDKTIGKCNIFPDEYRAPKNSPIAMIFNEINELSTIRSYSIYLTGWFINQEFKKAYLNKLLDLLIKTNGEKPIDARQFKKLREETIAESIGKETLKDVENEEKLEKEDHKWKLKGLKLNTNGKIQYNDLSSLAKFVHKLKQHLKLDFLLEDQYATLDKINFLQSLFVYLGKHLRYSNRVDSANLKEFSDSNKLFERILQKQKDGLFKLFEQTDKDDEKILAQTHSLSTKAMLLAITRMTNLDNDEDNQKNNDKGWNFEAIKNFDQKFIDITKKNNNLSLKQNKRYLDDRFINDAILSPGVKRILREATKVFNAILKQFSEEYDVTKVVIELARELSEEKELENTKNYKKLIKKNGDKISEGLKALGISEDEIKDILKSPTKSYKFLLWLQQDHIDPYSLKEIAFDDIFTKTEKFEIDHIIPYSISFDDSSSNKLLVLAESNQAKSNQTPYEFISSGNAGIKWEDYEAYCRKFKDGDSSLLDSTQRSKKFAKMMKTDTSSKYDIGFLARNLNDTRYATIVFRDALEDYANNHLVEDKPMFKVVCINGSVTSFLRKNFDDSSYAKKDRDKNIHHAVDASIISIFSNETKTLFNQLTQFADYKLFKNTDGSWKKIDPKTGVVTEVTDENWKQIRVRNQVSEIAKVIEKYIQDSNIERKARYSRKIENKTNISLFNDTVYSAKKVGYEDQIKRKNLKTLDIHESAKENKNSKVKRQFVYRKLVNVSLLNNDKLADLFAEKEDILMYRANPWVINLAEQIFNEYTENKKIKSQNVFEKYMLDLTKEFPEKFSEFLVKSMLRNKTAIIYDDKKNIVHRIKRLKMLSSELKENKLSNVIIRSKNQSGTKLSYQDTINSLALMIMRSIDPTAKKQYIRVPLNTLNLHLGDHDFDLHNMDAYLKKPKFVKYLKANEIGDEYKPWRVLTSGTLLIHKKDKKLMYISSFQNLNDVIEIKNLIETEYKENDDSDSKKKKKANRFLMTLSTILNDYILLDAKDNFDILGLSKNRIDEILNSKLGLDKIVK

SEQ ID NO: 385 - protein, 1138 aa, Acidothermus cellulolyticus
MGGSEVGTVPVTWRLGVDVGERSIGLAAVSYEEDKPKEILAAVSWIHDGGVGDERSGASRLALRGMARRARRLRRFRRARLRDLDMLLSELGWTPLPDKNVSPVDAWLARKRLAEEYVVDETERRRLLGYAVSHMARHRGWRNPWTTIKDLKNLPQPSDSWERTRESLEARYSVSLEPGTVGQWAGYLLQRAPGIRLNPTQQSAGRRAELSNATAFETRLRQEDVLWELRCIADVQGLPEDVVSNVIDAVFCQKRPSVPAERIGRDPLDPSQLRASRACLEFQEYRIVAAVANLRIRDGSGSRPLSLEERNAVIEALLAQTERSLTWSDIALEILKLPNESDLTSVPEEDGPSSLAYSQFAPFDETSARIAEFIAKNRRKIPTFAQWWQEQDRTSRSDLVAALADNSIAGEEEQELLVHLPDAELEALEGLALPSGRVAYSRLTLSGLTRVMRDDGVDVHNARKTCFGVDDNWRPPLPALHEATGHPVVDRNLAILRKFLSSATMRWGPPQSIVVELARGASESRERQAEEEAARRAHRKANDRIRAELRASGLSDPSPADLVRARLLELYDCHCMYCGAPISWENSELDHIVPRTDGGSNRHENLAITCGACNKEKGRRPFASWAETSNRVQLRDVIDRVQKLKYSGNMYWTRDEFSRYKKSVVARLKRRTSDPEVIQSIESTGYAAVALRDRLLSYGEKNGVAQVAVFRGGVTAEARRWLDISIERLFSRVAIFAQSTSTKRLDRRHHAVDAVVLTTLTPGVAKTLADARSRRVSAEFWRRPSDVNRHSTEEPQSPAYRQWKESCSGLGDLLISTAARDSIAVAAPLRLRPTGALHEETLRAFSEHTVGAAWKGAELRRIVEPEVYAAFLALTDPGGRFLKVSPSEDVLPADENRHIVLSDRVLGPRDRVKLFPDDRGSIRVRGGAAYIASFHHARVFRWGSSHSPSFALLRVSLADLAVAGLLRDGVDVFTAELPPWTPAWRYASIALVKAVESGDAKQVGWLVPGDELDFGPEGVTTAAGDLSMFLKYFPERHWVVTGFEDDKRINLKPAFLSAEQAEVLRTERSDRPDTLTEAGEILAQFFPRCWRATVAKVLCHPGLTVIRRTALGQPRWRRGHLPYSWRPWSADPWSGGTP

SEQ ID NO: 386 - protein, 1265 aa, Mycoplasma ovipneumoniae
MHNKKNITIGFDLGIASIGWAIIDSTTSKILDWGTRTFEERKTANERRAFRSTRRNIRRKAYRNQRFINLILKYKDLFELKNISDIQRANKKDTENYEKIISFFTEIYKKCAAKHSNILEVKVKALDSKIEKLDLIWILHDYLENRGFFYDLEEENVADKYEGIEHPSILLYDFFKKNGFFKSNSSIPKDLGGYSFSNLQWVNEIKKLFEVQEINPEFSEKFLNLFTSVRDYAKGPGSEHSASEYGIFQKDEKGKVFKKYDNIWDKTIGKCSFFVEENRSPVNYPSYEIFNLLNQLINLSTDLKTTNKKIWQLSSNDRNELLDELLKVKEKAKIISISLKKNEIKKIILKDFGFEKSDIDDQDTIEGRKIIKEEPTTKLEVTKHLLATIYSHSSDSNWININNILEFLPYLDAICIILDREKSRGQDEVLKKLTEKNIFEVLKIDREKQLDFVKSIFSNTKFNFKKIGNFSLKAIREFLPKMFEQNKNSEYLKWKDEEIRRKWEEQKSKLGKTDKKTKYLNPRIFQDEIISPGTKNTFEQAVLVLNQIIKKYSKENIIDAIIIESPREKNDKKTIEEIKKRNKKGKGKTLEKLFQILNLENKGYKLSDLETKPAKLLDRLRFYHQQDGIDLYTLDKINIDQLINGSQKYEIEHIIPYSMSYDNSQANKILTEKAENLKKGKLIASEYIKRNGDEFYNKYYEKAKELFINKYKKNKKLDSYVDLDEDSAKNRFRFLTLQDYDEFQVEFLARNLNDTRYSTKLFYHALVEHFENNEFFTYIDENSSKHKVKISTIKGHVTKYFRAKPVQKNNGPNENLNNNKPEKIEKNRENNEHHAVDAAIVAIIGNKNPQIANLLTLADNKTDKKFLLHDENYKENIETGELVKIPKFEVDKLAKVEDLKKIIQEKYEEAKKHTAIKFSRKTRTILNGGLSDETLYGFKYDEKEDKYFKIIKKKLVTSKNEELKKYFENPFGKKADGKSEYTVLMAQSHLSEFNKLKEIFEKYNGFSNKTGNAFVEYMNDLALKEPTLKAEIESAKSVEKLLYYNFKPSDQFTYHDNINNKSFKRFYKNIRIIEYKSIPIKFKILSKHDGGKSFKDTLFSLYSLVYKVYENGKESYKSIPVTSQMRNFGIDEFDFLDENLYNKEKLDIYKSDFAKPIPVNCKPVFVLKKGSILKKKSLDIDDFKETKETEEGNYYFISTISKRFNRDTAYGLKPLKLSVVKPVAEPSTNPIFKEYIPIHLDELGNEYPVKIKEHTDDEKLMCTIK

SEQ ID NO: 387 - DNA, 22 bp, Artificial Sequence
  CEP290-11 targeting domain (DNA)
gacactgccaatagggataggt

SEQ ID NO: 388 - DNA, 22 bp, Artificial Sequence
  CEP290-64 targeting domain (DNA)
gtcaaaagctaccggttacctg

SEQ ID NO: 389 - DNA, 22 bp, Artificial Sequence
  CEP290-323 targeting domain (DNA)
gttctgtcctcagtaaaaggta

SEQ ID NO: 390 - DNA, 20 bp, Artificial Sequence
  CEP290-490 targeting domain (DNA)
gaatagtttgttctgggtac

SEQ ID NO: 391 - DNA, 20 bp, Artificial Sequence
  CEP290-492 targeting domain (DNA)
gagaaagggatgggcactta

SEQ ID NO: 392 - DNA, 20 bp, Artificial Sequence
  CEP290-496/-B115/-B1041/-85 targeting domain (DNA)
gatgcagaactagtgtagac

SEQ ID NO: 393 - DNA, 20 bp, Artificial Sequence
  CEP290-502/-B1055 targeting domain (DNA)
gtcacatgggagtcacaggg

SEQ ID NO: 394 - DNA, 19 bp, Artificial Sequence
  CEP290-504 targeting domain (DNA)
gagtatctcctgtttggca

SEQ ID NO: 395 - RNA, 20 nt, Artificial Sequence
  CEP290-B4/-B1000/-54 targeting domain (RNA)
gagauacucacaauuacaac

SEQ ID NO: 396 - RNA, 20 nt, Artificial Sequence
  CEP290-B28 targeting domain (RNA)
gauacucacaauuacaacug

SEQ ID NO: 397 - RNA, 17 nt, Artificial Sequence
  CEP290-B1001 targeting domain (RNA)
gauacucacaauuacaa

SEQ ID NO: 398 - RNA, 22 nt, Artificial Sequence
  CEP290-12 targeting domain (RNA)
gcaccuggccccaguuguaauu

SEQ ID NO: 399 - DNA, 25 bp, Artificial Sequence
  PCR primer ITR-Titer-fwd
aacatgctacgcagagagggagtgg

SEQ ID NO: 400 - DNA, 29 bp, Artificial Sequence
  PCR primer ITR-Titer-rev
catgagacaaggaacccctagtgatggag

SEQ ID NO: 401 - DNA, 617 bp, Artificial Sequence
  CMV promoter
cattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgc

SEQ ID NO: 402 - DNA, 252 bp, Artificial Sequence
  EFS promoter
tcgagtggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtgtcgtgaccgcgg

SEQ ID NO: 403 - DNA, 292 bp, Homo sapiens
gggccccagaagcctggtggttgtttgtccttctcaggggaaaagtgaggcggccccttggaggaaggggccgggcagaatgatctaatcggattccaagcagctcaggggattgtctttttctagcaccttcttgccactcctaagcgtcctccgtgaccccggctgggatttcgcctggtgctgtgtcagccccggtctcccaggggcttcccagtggtccccaggaaccctcgacagggcccggtctctctcgtccagcaagggcagggacgggccacaggccaagggc

SEQ ID NO: 404 - DNA, 113 bp, Homo sapiens
gcctgtagccttaatctctcctagcagggggtttgggggagggaggaggagaaagaaagggccccttatggctgagacacaatgacccagccacaaggagggattaccgggcg

SEQ ID NO: 405 - DNA, 281 bp, Homo sapiens
aggtaggaagtggcctttaactccatagaccctatttaaacagcttcggacaggtttaaacatctccttggataattcctagtatccctgttcccactcctactcagggatgatagctctaagaggtgttaggggattaggctgaaaatgtaggtcacccctcagccatctgggaactagaatgagtgagagaggagagaggggcagagacacacacattcgcatattaaggtgacgcgtgtggcctcgaacaccgagcgaccctgcagcgacccgcttaa

SEQ ID NO: 406 - DNA, 235 bp, Homo sapiens
attttaatctcactagggttctgggagcacccccccccaccgctcccgccctccacaaagctcctgggcccctcctcccttcaaggattgcgaagagctggtcgcaaatcctcctaagccaccagcatctcggtcttcagctcacaccagccttgagcccagcctgcggccaggggaccacgcacgtcccacccacccagcgactccccagccgctgcccactcttcctcactca

SEQ ID NO: 407 - DNA, 143 bp, Artificial Sequence
  AAV1 left ITR sequence
ttgcccactccctctctgcgcgctcgctcgctcggtggggcctgcggaccaaaggtccgcagacggcagagctctgctctgccggccccaccgagcgagcgagcgcgcagagagggagtgggcaactccatcactaggggtaa

SEQ ID NO: 408 - DNA, 145 bp, Artificial Sequence
  AAV2 left ITR sequence
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcct

SEQ ID NO: 409 - DNA, 142 bp, Artificial Sequence
  AAV3B left ITR sequence
tggccactccctctatgcgcactcgctcgctcggtggggcctggcgaccaaaggtcgccagacggacgtgctttgcacgtccggccccaccgagcgagcgagtgcgcatagagggagtggccaactccatcactagaggtat

SEQ ID NO: 410 - DNA, 146 bp, Artificial Sequence
  AAV4 left ITR sequence
ttggccactccctctatgcgcgctcgctcactcactcggccctggagaccaaaggtctccagactgccggcctctggccggcagggccgagtgagtgagcgagcgcgcatagagggagtggccaactccatcatctaggtttgccc

SEQ ID NO: 411 - DNA, 155 bp, Artificial Sequence
  AAV5 left ITR sequence
ctctcccccctgtcgcgttcgctcgctcgctggctcgtttgggggggtggcagctcaaagagctgccagacgacggccctctggccgtcgcccccccaaacgagccagcgagcgagcgaacgcgacaggggggagagtgccacactctcaagcaa

SEQ ID NO: 412 - DNA, 143 bp, Artificial Sequence
  AAV6 left ITR sequence
atacccctagtgatggagttgcccactccctctatgcgcgctcgctcgctcggtggggccggcagagcagagctctgccgtctgcggacctttggtccgcaggccccaccgagcgagcgagcgcgcatagagggagtgggcaa

SEQ ID NO: 413 - DNA, 145 bp, Artificial Sequence
  AAV7 left ITR sequence
ttggccactccctctatgcgcgctcgctcgctcggtggggcctgcggaccaaaggtccgcagacggcagagctctgctctgccggccccaccgagcgagcgagcgcgcatagagggagtggccaactccatcactaggggtaccg

SEQ ID NO: 414 - DNA, 145 bp, Artificial Sequence
  AAV8 left ITR sequence
cagagagggagtggccaactccatcactaggggtagcgcgaagcgcctcccacgctgccgcgtcagcgctgacgtaaattacgtcataggggagtggtcctgtattagctgtcacgtgagtgcttttgcggcattttgcgacacc

SEQ ID NO: 415 - DNA, 145 bp, Artificial Sequence
  AAV9 left ITR sequence
cagagagggagtggccaactccatcactaggggtaatcgcgaagcgcctcccacgctgccgcgtcagcgctgacgtagattacgtcataggggagtggtcctgtattagctgtcacgtgagtgcttttgcgacattttgcgacac

SEQ ID NO: 416 - DNA, 19 bp, Artificial Sequence
  Spacer
cagatctgaattcggtacc

SEQ ID NO: 417 - DNA, 264 bp, Artificial Sequence
  Exemplary U6 promoter
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacc

SEQ ID NO: 418 - DNA, 82 bp, Artificial Sequence
  Exemplary S. auerus gRNA scaffold
gttttagtactctggaaacagaatctactaaaacaaggcaaaatgccgtgtttatctcgtcaacttgttggcgagatttttt

SEQ ID NO: 419 - DNA, 50 bp, Artificial Sequence
  Spacer
ggtaccgctagcgcttaagtcgcgatgtacgggccagatatacgcgttga

SEQ ID NO: 420 - DNA, 30 bp, Artificial Sequence
  Exemplary N-ter NLS
ccgaagaaaaagcgcaaggtcgaagcgtcc

SEQ ID NO: 421 - skipped

SEQ ID NO: 422 - DNA, 21 bp, Artificial Sequence
  Exemplary C-ter NLS
cccaagaagaagaggaaagtc

SEQ ID NO: 423 - DNA, 66 bp, Artificial Sequence
  Exemplary 3x FLAG
gactacaaagaccatgacggtgattataaagatcatgacatcgattacaaggatgacgatgacaag

SEQ ID NO: 424 - DNA, 60 bp, Artificial Sequence
  Mini polyA
tagcaataaaggatcgtttattttcattggaagcgtgtgttggttttttgatcaggcgcg

SEQ ID NO: 425 - DNA, 86 bp, Artificial Sequence
  Spacer
tccaagcttcgcaggaaagaacatgtgagcaaaaggccagcaaaaggcgttaactctagatttaaatgcatgctggggagagatct

SEQ ID NO: 426 - protein, 22 aa, Artificial Sequence
  Exemplary 3x FLAG
DYKDHDGDYKDHDIDYKDDDDK

SEQ ID NO: 427 - DNA, 20 bp, Artificial Sequence
  Spacer
cgacttagttcgatcgaagg

SEQ ID NO: 428 - DNA, 5217 bp, Artificial Sequence
  Exemplary recombinant AAV genome containing CMV promoter (5'->3' upper strand)
  misc_feature (429)..(454): a, c, g, or t
  misc_feature (821)..(846): a, c, g, or t
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctcagatctgaattcggtaccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccnnnnnnnnnnnnnnnnnnnnnnnnnngttttagtactctggaaacagaatctactaaaacaaggcaaaatgccgtgtttatctcgtcaacttgttggcgagattttttcgacttagttcgatcgaaggaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccnnnnnnnnnnnnnnnnnnnnnnnnnngttttagtactctggaaacagaatctactaaaacaaggcaaaatgccgtgtttatctcgtcaacttgttggcgagattttttggtaccgctagcgcttaagtcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcgcggccgctaatacgactcactatagggagagccgccaccatgccgaagaaaaagcgcaaggtcgaagcgtccatgaaaaggaactacattctggggctggacatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagagaactctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggcggatcccccaagaagaagaggaaagtctcgagcgactacaaagaccatgacggtgattataaagatcatgacatcgattacaaggatgacgatgacaagtagcaataaaggatcgtttattttcattggaagcgtgtgttggttttttgatcaggcgcgtccaagcttcgcaggaaagaacatgtgagcaaaaggccagcaaaaggcgttaactctagatttaaatgcatgctggggagagatctaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaa

SEQ ID NO: 429 - DNA, 4870 bp, Artificial Sequence
  Exemplary recombinant AAV genome containing EFS promoter (5'->3' upper strand)
  misc_feature (429)..(454): a, c, g, or t
  misc_feature (821)..(846): a, c, g, or t
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctcagatctgaattcggtaccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccnnnnnnnnnnnnnnnnnnnnnnnnnngttttagtactctggaaacagaatctactaaaacaaggcaaaatgccgtgtttatctcgtcaacttgttggcgagattttttcgacttagttcgatcgaaggaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccnnnnnnnnnnnnnnnnnnnnnnnnnngttttagtactctggaaacagaatctactaaaacaaggcaaaatgccgtgtttatctcgtcaacttgttggcgagattttttggtaccgctagcgcttaagtcgcgatgtacgggccagatatacgcgttgacattgattattgactagttcgagtggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtgtcgtgaccgcgggcggccgctaatacgactcactatagggagagccgccaccatgccgaagaaaaagcgcaaggtcgaagcgtccatgaaaaggaactacattctggggctggacatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagagaactctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggcggatcccccaagaagaagaggaaagtctcgagcgactacaaagaccatgacggtgattataaagatcatgacatcgattacaaggatgacgatgacaagtagcaataaaggatcgtttattttcattggaagcgtgtgttggttttttgatcaggcgcgtccaagcttcgcaggaaagaacatgtgagcaaaaggccagcaaaaggcgttaactctagatttaaatgcatgctggggagagatctaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaa

SEQ ID NO: 430 - DNA, 4910 bp, Artificial Sequence
  Exemplary recombinant AAV genome containing CRK1 promoter (5'->3' upper strand)
  misc_feature (429)..(454): a, c, g, or t
  misc_feature (821)..(846): a, c, g, or t
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctcagatctgaattcggtaccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccnnnnnnnnnnnnnnnnnnnnnnnnnngttttagtactctggaaacagaatctactaaaacaaggcaaaatgccgtgtttatctcgtcaacttgttggcgagattttttcgacttagttcgatcgaaggaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccnnnnnnnnnnnnnnnnnnnnnnnnnngttttagtactctggaaacagaatctactaaaacaaggcaaaatgccgtgtttatctcgtcaacttgttggcgagattttttggtaccgctagcgcttaagtcgcgatgtacgggccagatatacgcgttgacattgattattgactagtgggccccagaagcctggtggttgtttgtccttctcaggggaaaagtgaggcggccccttggaggaaggggccgggcagaatgatctaatcggattccaagcagctcaggggattgtctttttctagcaccttcttgccactcctaagcgtcctccgtgaccccggctgggatttcgcctggtgctgtgtcagccccggtctcccaggggcttcccagtggtccccaggaaccctcgacagggcccggtctctctcgtccagcaagggcagggacgggccacaggccaagggcgcggccgctaatacgactcactatagggagagccgccaccatgccgaagaaaaagcgcaaggtcgaagcgtccatgaaaaggaactacattctggggctggacatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagagaactctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggcggatcccccaagaagaagaggaaagtctcgagcgactacaaagaccatgacggtgattataaagatcatgacatcgattacaaggatgacgatgacaagtagcaataaaggatcgtttattttcattggaagcgtgtgttggttttttgatcaggcgcgtccaagcttcgcaggaaagaacatgtgagcaaaaggccagcaaaaggcgttaactctagatttaaatgcatgctggggagagatctaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaa

SEQ ID NO: 431 - DNA, 4731 bp, Artificial Sequence
  Exemplary recombinant AAV genome containing CRX promoter (5'->3' upper strand)
  misc_feature (429)..(454): a, c, g, or t
  misc_feature (821)..(846): a, c, g, or t
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctcagatctgaattcggtaccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccnnnnnnnnnnnnnnnnnnnnnnnnnngttttagtactctggaaacagaatctactaaaacaaggcaaaatgccgtgtttatctcgtcaacttgttggcgagattttttcgacttagttcgatcgaaggaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccnnnnnnnnnnnnnnnnnnnnnnnnnngttttagtactctggaaacagaatctactaaaacaaggcaaaatgccgtgtttatctcgtcaacttgttggcgagattttttggtaccgctagcgcttaagtcgcgatgtacgggccagatatacgcgttgacattgattattgactagtgcctgtagccttaatctctcctagcagggggtttgggggagggaggaggagaaagaaagggccccttatggctgagacacaatgacccagccacaaggagggattaccgggcggcggccgctaatacgactcactatagggagagccgccaccatgccgaagaaaaagcgcaaggtcgaagcgtccatgaaaaggaactacattctggggctggacatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagagaactctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggcggatcccccaagaagaagaggaaagtctcgagcgactacaaagaccatgacggtgattataaagatcatgacatcgattacaaggatgacgatgacaagtagcaataaaggatcgtttattttcattggaagcgtgtgttggttttttgatcaggcgcgtccaagcttcgcaggaaagaacatgtgagcaaaaggccagcaaaaggcgttaactctagatttaaatgcatgctggggagagatctaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaa

SEQ ID NO: 432 - DNA, 4899 bp, Artificial Sequence
  Exemplary recombinant AAV genome containing NRL promoter (5'->3' upper strand)
  misc_feature (429)..(454): a, c, g, or t
  misc_feature (821)..(846): a, c, g, or t
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctcagatctgaattcggtaccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccnnnnnnnnnnnnnnnnnnnnnnnnnngttttagtactctggaaacagaatctactaaaacaaggcaaaatgccgtgtttatctcgtcaacttgttggcgagattttttcgacttagttcgatcgaaggaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccnnnnnnnnnnnnnnnnnnnnnnnnnngttttagtactctggaaacagaatctactaaaacaaggcaaaatgccgtgtttatctcgtcaacttgttggcgagattttttggtaccgctagcgcttaagtcgcgatgtacgggccagatatacgcgttgacattgattattgactagtaggtaggaagtggcctttaactccatagaccctatttaaacagcttcggacaggtttaaacatctccttggataattcctagtatccctgttcccactcctactcagggatgatagctctaagaggtgttaggggattaggctgaaaatgtaggtcacccctcagccatctgggaactagaatgagtgagagaggagagaggggcagagacacacacattcgcatattaaggtgacgcgtgtggcctcgaacaccgagcgaccctgcagcgacccgcttaagcggccgctaatacgactcactatagggagagccgccaccatgccgaagaaaaagcgcaaggtcgaagcgtccatgaaaaggaactacattctggggctggacatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagagaactctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggcggatcccccaagaagaagaggaaagtctcgagcgactacaaagaccatgacggtgattataaagatcatgacatcgattacaaggatgacgatgacaagtagcaataaaggatcgtttattttcattggaagcgtgtgttggttttttgatcaggcgcgtccaagcttcgcaggaaagaacatgtgagcaaaaggccagcaaaaggcgttaactctagatttaaatgcatgctggggagagatctaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaa

SEQ ID NO: 433 - DNA, 4853 bp, Artificial Sequence
  Exemplary recombinant AAV genome containing NRL promoter (5'->3' upper strand)
  misc_feature (429)..(454): a, c, g, or t
  misc_feature (821)..(846): a, c, g, or t
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctcagatctgaattcggtaccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccnnnnnnnnnnnnnnnnnnnnnnnnnngttttagtactctggaaacagaatctactaaaacaaggcaaaatgccgtgtttatctcgtcaacttgttggcgagattttttcgacttagttcgatcgaaggaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccnnnnnnnnnnnnnnnnnnnnnnnnnngttttagtactctggaaacagaatctactaaaacaaggcaaaatgccgtgtttatctcgtcaacttgttggcgagattttttggtaccgctagcgcttaagtcgcgatgtacgggccagatatacgcgttgacattgattattgactagtattttaatctcactagggttctgggagcacccccccccaccgctcccgccctccacaaagctcctgggcccctcctcccttcaaggattgcgaagaactggtcgcaaatcctcctaagccaccagcatctcggtcttcagctcacaccagccttgagcccagcctgcggccaggggaccacgcacgtcccacccacccagcgactccccagccgctgcccactcttcctcactcagcggccgctaatacgactcactatagggagagccgccaccatgccgaagaaaaagcgcaaggtcgaagcgtccatgaaaaggaactacattctggggctggacatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagagaactctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggcggatcccccaagaagaagaggaaagtctcgagcgactacaaagaccatgacggtgattataaagatcatgacatcgattacaaggatgacgatgacaagtagcaataaaggatcgtttattttcattggaagcgtgtgttggttttttgatcaggcgcgtccaagcttcgcaggaaagaacatgtgagcaaaaggccagcaaaaggcgttaactctagatttaaatgcatgctggggagagatctaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaa

SEQ ID NO: 434 - protein, 7 aa, Artificial Sequence
  Exemplary N-ter NLS
PKKKRKV

SEQ ID NO: 435 - skipped

SEQ ID NO: 436 - DNA, 143 bp, Artificial Sequence
  AAV1 right ITR sequence
ttacccctagtgatggagttgcccactccctctctgcgcgctcgctcgctcggtggggccggcagagcagagctctgccgtctgcggacctttggtccgcaggccccaccgagcgagcgagcgcgcagagagggagtgggcaa

SEQ ID NO: 437 - DNA, 145 bp, Artificial Sequence
  AAV2 right ITR sequence
aggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaa

SEQ ID NO: 438 - DNA, 142 bp, Artificial Sequence
  AAV3B right ITR sequence
atacctctagtgatggagttggccactccctctatgcgcactcgctcgctcggtggggccggacgtgcaaagcacgtccgtctggcgacctttggtcgccaggccccaccgagcgagcgagtgcgcatagagggagtggcca

SEQ ID NO: 439 - DNA, 146 bp, Artificial Sequence
  AAV4 right ITR sequence
gggcaaacctagatgatggagttggccactccctctatgcgcgctcgctcactcactcggccctgccggccagaggccggcagtctggagacctttggtctccagggccgagtgagtgagcgagcgcgcatagagggagtggccaa

SEQ ID NO: 440 - DNA, 155 bp, Artificial Sequence
  AAV5 right ITR sequence
ttgcttgagagtgtggcactctcccccctgtcgcgttcgctcgctcgctggctcgtttgggggggcgacggccagagggccgtcgtctggcagctctttgagctgccacccccccaaacgagccagcgagcgagcgaacgcgacaggggggagag

SEQ ID NO: 441 - DNA, 143 bp, Artificial Sequence
  AAV6 right ITR sequence
ttgcccactccctctatgcgcgctcgctcgctcggtggggcctgcggaccaaaggtccgcagacggcagagctctgctctgccggccccaccgagcgagcgagcgcgcatagagggagtgggcaactccatcactaggggtat

SEQ ID NO: 442 - DNA, 145 bp, Artificial Sequence
  AAV7 right ITR sequence
cggtacccctagtgatggagttggccactccctctatgcgcgctcgctcgctcggtggggccggcagagcagagctctgccgtctgcggacctttggtccgcaggccccaccgagcgagcgagcgcgcatagagggagtggccaa

SEQ ID NO: 443 - DNA, 145 bp, Artificial Sequence
  AAV8 right ITR sequence
ggtgtcgcaaaatgccgcaaaagcactcacgtgacagctaatacaggaccactcccctatgacgtaatttacgtcagcgctgacgcggcagcgtgggaggcgcttcgcgctacccctagtgatggagttggccactccctctctg

SEQ ID NO: 444 - DNA, 145 bp, Artificial Sequence
  AAV9 right ITR sequence
gtgtcgcaaaatgtcgcaaaagcactcacgtgacagctaatacaggaccactcccctatgacgtaatctacgtcagcgctgacgcggcagcgtgggaggcgcttcgcgattacccctagtgatggagttggccactccctctctg

SEQ ID NO: 445 - DNA, 5217 bp, Artificial Sequence
  Exemplary recombinant AAV genome containing CMV promoter (3'->5' lower strand)
  misc_feature (4372)..(4397): a, c, g, or t
  misc_feature (4764)..(4789): a, c, g, or t
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctagatctctccccagcatgcatttaaatctagagttaacgccttttgctggccttttgctcacatgttctttcctgcgaagcttggacgcgcctgatcaaaaaaccaacacacgcttccaatgaaaataaacgatcctttattgctacttgtcatcgtcatccttgtaatcgatgtcatgatctttataatcaccgtcatggtctttgtagtcgctcgagactttcctcttcttcttgggggatccgccctttttgataatctgagggtgctttttgctcttcacctcatacaggtttcccagaatgtcggttgagtactttttgatactctgagtcttagaggcaattgttttgataattcgaggggggcgcttatcattcatgttttccagatactctcggtaagtgatgtcaatcatattcacttcaatgcggttcagcagatcattgttcaccccgatgaccctatacagttcgccattgatcttaatcaggtcgttgttgtaaaaggaggcgatgaactctgcctggttgctaatctttttcagctttttagcctcttcgtagcacttgctattcacttcatagtagttctcctttttgatgacatccagattcttgacagtcacaaatttatacacgccgttgtccagatagacatcgaatctgtatggcttcagtgacagcttgaccaccttgttgcgactgttagggtaatcgtctgtgatgtccagatgggcattcagcttgttcccatagtacttgatcttcttgatcacggggccattatcctttttgctatacttggtcaggtagttcccagtctcttcatagtacttatacagtgggttcttctcgtcgccgtactgctccataatcagcttcagtttctgatatgtctgaggatcatggtggtacatcagcagcttctcgggacttttgttgatcagctttttcagcttgtcattatctttgtcgtacagtccgttcagattgttcacaatcagggtattccccttatcgtcttttcttgtactatacagggtgtcattgatcagctctctgttgggctttttatccacccggtgagagtacttgtagtccttgaaatccttgatatgcttgatctggtgaggagtgatgaaaatctccttgtactcctgttctgtctcgatttcgggcatagattcggcctgcttctcttcgaacatctggttctccatcactttcttggctttgtccagctttttccactccttaaagatgaagtcggcatttgcgataatcagagcatcttcggcatggtgcttgtaccctttgttgcgctcctttttaaacttccatttgcgcctcagaaaagatgtgaacccgccgttgatggacttgactttcacatccagattgttcacccggaaataggatcgcagcagattcatcaggccgcgagtagcgtatcttgtgtccaccagattccggttaataaaatccttctggacggagaatctgttgatgtcccgctcttccagcaggtactcctttttggtcttgctgatgcggccctttcctttggccagattcagaatgtgctttttaaaggtttcgtaagagatcttggaatctgaactagacaggtactggaaaggagtcctattgccctttttagagttctcttcctgcttgaccagcaccttgttgttaaaggaattgtcgaaggacacgcttctggggataatatgatcgacctcgtagttgaatggattgttcagcaggtcctccagggggatggcctccagagaatacagacactttccctcctgcatatcgtgcagcttgattttttcaatcaggtactttgcgttctctttcccggtagttcggataatctcttcaatgcgttcattggtctgccggtttcgtttctgcatctcattgatcatcttctgtgcgtccttgctgttcttctccctagccagctcgataatgatatcattgggcaggccgtacttcttgatgatggcgttgatcactttgatgctctggatgaagctccgcttgaccacgggtgacagaatgaaatcgtccaccagtgtggttgggatctctttctgctgactcaggtccaccttttttgggaccagcttcagccggttaaagattgcaatctgattgtcgtttgtatgccacagctcatccagaatcagattgatagctttcagggacaggttgtgtgttccggtgtaccccttcagattactaatctgttcgatctcttcctgggtcagctcgctgttcaggttagtcagctcttcctggatgtcctcggagctctggtagatagtcaggatcttagcaatctgatccagcagttcggcgttctcaatgatttctttccgtgctgtgatgtccttaatatcgtgatacactttcagattggtgaactctggttttccagtgcttgtcacccggtagcccttgatgtcctcttcgttgaccaggatctccttagcaatctgtttcagtgtaggctttttcttctgcttaaacacgttttcgatgatctggaacttctcatagtattccagtttctcgttttcatccctggtgatgaccaggttgttcaggtcattcagggcgttgtacagatctgcgttataagcgtacttgacgcttctcagctcttctggaaaataggtgcaatgtcccatcagcatctcgtaccattccttgatgtctttccatccgaaggggctcccttctcctggtccctcatagtaggttctccgagtctccagcaggtcgatataagtatcgatgaagctctgatccagctggtggtaagccttctgcactttcagcagctgcttggcttctttgacgtagtcgcttgtcttgaacctattaattgaccctctcacctcgccatctttcttcagccgttccagctgcagctctgcgacatacttctcttccagagctttgctattgcgtgagatctgttcctttgtagacagctcgttgccggtgtcctcttccacctcattgacgttatgcactcctcggcgcttagccaggtgcagcagagctgcggaaaactcttcctctgacagcttctgactcaggcctttcaccctggcttcataaggattaattccactcagctcagaatggtcggtcagcaggttgtaatcgaacagcagtttcttcaccctctggattctgtgccttctccgtcgtttcaggcgcctggctcccctcttgcttctccgtccctcattgttttccacgttggcctccttgaacagtctgacgcctgcgtcgatcacgtcccttgtttcatagtcaataatcccataccccacgcttgtaatcccgatgtccagccccagaatgtagttccttttcatggacgcttcgaccttgcgctttttcttcggcatggtggcggctctccctatagtgagtcgtattagcggccgcgcggatctctagcggatctgacggttcactaaaccagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatagtccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtcaataatcaatgtcaacgcgtatatctggcccgtacatcgcgacttaagcgctagcggtaccaaaaaatctcgccaacaagttgacgagataaacacggcattttgccttgttttagtagattctgtttccagagtactaaaacnnnnnnnnnnnnnnnnnnnnnnnnnnggtgtttcgtcctttccacaagatatataaagccaagaaatcgaaatactttcaagttacggtaagcatatgatagtccattttaaaacataattttaaaactgcaaactacccaagaaattattactttctacgtcacgtattttgtactaatatctttgtgtttacagtcaaattaattctaattatctctctaacagccttgtatcgtatatgcaaatatgaaggaatcatgggaaataggccctcttcctgcccgaccttccttcgatcgaactaagtcgaaaaaatctcgccaacaagttgacgagataaacacggcattttgccttgttttagtagattctgtttccagagtactaaaacnnnnnnnnnnnnnnnnnnnnnnnnnnggtgtttcgtcctttccacaagatatataaagccaagaaatcgaaatactttcaagttacggtaagcatatgatagtccattttaaaacataattttaaaactgcaaactacccaagaaattattactttctacgtcacgtattttgtactaatatctttgtgtttacagtcaaattaattctaattatctctctaacagccttgtatcgtatatgcaaatatgaaggaatcatgggaaataggccctcttcctgcccgaccttggtaccgaattcagatctgaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaa

SEQ ID NO: 446 - DNA, 4870 bp, Artificial Sequence
  Exemplary recombinant AAV genome containing EFS promoter (3'->5' lower strand)
  misc_feature (4025)..(4050): a, c, g, or t
  misc_feature (4417)..(4442): a, c, g, or t
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctagatctctccccagcatgcatttaaatctagagttaacgccttttgctggccttttgctcacatgttctttcctgcgaagcttggacgcgcctgatcaaaaaaccaacacacgcttccaatgaaaataaacgatcctttattgctacttgtcatcgtcatccttgtaatcgatgtcatgatctttataatcaccgtcatggtctttgtagtcgctcgagactttcctcttcttcttgggggatccgccctttttgataatctgagggtgctttttgctcttcacctcatacaggtttcccagaatgtcggttgagtactttttgatactctgagtcttagaggcaattgttttgataattcgaggggggcgcttatcattcatgttttccagatactctcggtaagtgatgtcaatcatattcacttcaatgcggttcagcagatcattgttcaccccgatgaccctatacagttcgccattgatcttaatcaggtcgttgttgtaaaaggaggcgatgaactctgcctggttgctaatctttttcagctttttagcctcttcgtagcacttgctattcacttcatagtagttctcctttttgatgacatccagattcttgacagtcacaaatttatacacgccgttgtccagatagacatcgaatctgtatggcttcagtgacagcttgaccaccttgttgcgactgttagggtaatcgtctgtgatgtccagatgggcattcagcttgttcccatagtacttgatcttcttgatcacggggccattatcctttttgctatacttggtcaggtagttcccagtctcttcatagtacttatacagtgggttcttctcgtcgccgtactgctccataatcagcttcagtttctgatatgtctgaggatcatggtggtacatcagcagcttctcgggacttttgttgatcagctttttcagcttgtcattatctttgtcgtacagtccgttcagattgttcacaatcagggtattccccttatcgtcttttcttgtactatacagggtgtcattgatcagctctctgttgggctttttatccacccggtgagagtacttgtagtccttgaaatccttgatatgcttgatctggtgaggagtgatgaaaatctccttgtactcctgttctgtctcgatttcgggcatagattcggcctgcttctcttcgaacatctggttctccatcactttcttggctttgtccagctttttccactccttaaagatgaagtcggcatttgcgataatcagagcatcttcggcatggtgcttgtaccctttgttgcgctcctttttaaacttccatttgcgcctcagaaaagatgtgaacccgccgttgatggacttgactttcacatccagattgttcacccggaaataggatcgcagcagattcatcaggccgcgagtagcgtatcttgtgtccaccagattccggttaataaaatccttctggacggagaatctgttgatgtcccgctcttccagcaggtactcctttttggtcttgctgatgcggccctttcctttggccagattcagaatgtgctttttaaaggtttcgtaagagatcttggaatctgaactagacaggtactggaaaggagtcctattgccctttttagagttctcttcctgcttgaccagcaccttgttgttaaaggaattgtcgaaggacacgcttctggggataatatgatcgacctcgtagttgaatggattgttcagcaggtcctccagggggatggcctccagagaatacagacactttccctcctgcatatcgtgcagcttgattttttcaatcaggtactttgcgttctctttcccggtagttcggataatctcttcaatgcgttcattggtctgccggtttcgtttctgcatctcattgatcatcttctgtgcgtccttgctgttcttctccctagccagctcgataatgatatcattgggcaggccgtacttcttgatgatggcgttgatcactttgatgctctggatgaagctccgcttgaccacgggtgacagaatgaaatcgtccaccagtgtggttgggatctctttctgctgactcaggtccaccttttttgggaccagcttcagccggttaaagattgcaatctgattgtcgtttgtatgccacagctcatccagaatcagattgatagctttcagggacaggttgtgtgttccggtgtaccccttcagattactaatctgttcgatctcttcctgggtcagctcgctgttcaggttagtcagctcttcctggatgtcctcggagctctggtagatagtcaggatcttagcaatctgatccagcagttcggcgttctcaatgatttctttccgtgctgtgatgtccttaatatcgtgatacactttcagattggtgaactctggttttccagtgcttgtcacccggtagcccttgatgtcctcttcgttgaccaggatctccttagcaatctgtttcagtgtaggctttttcttctgcttaaacacgttttcgatgatctggaacttctcatagtattccagtttctcgttttcatccctggtgatgaccaggttgttcaggtcattcagggcgttgtacagatctgcgttataagcgtacttgacgcttctcagctcttctggaaaataggtgcaatgtcccatcagcatctcgtaccattccttgatgtctttccatccgaaggggctcccttctcctggtccctcatagtaggttctccgagtctccagcaggtcgatataagtatcgatgaagctctgatccagctggtggtaagccttctgcactttcagcagctgcttggcttctttgacgtagtcgcttgtcttgaacctattaattgaccctctcacctcgccatctttcttcagccgttccagctgcagctctgcgacatacttctcttccagagctttgctattgcgtgagatctgttcctttgtagacagctcgttgccggtgtcctcttccacctcattgacgttatgcactcctcggcgcttagccaggtgcagcagagctgcggaaaactcttcctctgacagcttctgactcaggcctttcaccctggcttcataaggattaattccactcagctcagaatggtcggtcagcaggttgtaatcgaacagcagtttcttcaccctctggattctgtgccttctccgtcgtttcaggcgcctggctcccctcttgcttctccgtccctcattgttttccacgttggcctccttgaacagtctgacgcctgcgtcgatcacgtcccttgtttcatagtcaataatcccataccccacgcttgtaatcccgatgtccagccccagaatgtagttccttttcatggacgcttcgaccttgcgctttttcttcggcatggtggcggctctccctatagtgagtcgtattagcggccgcccgcggtcacgacacctgtgttctggcggcaaacccgttgcgaaaaagaacgttcacggcgactactgcacttatatacggttctcccccaccctcgggaaaaaggcggagccagtacacgacatcactttcccagtttaccccgcgccaccttctctaggcaccggttcaattgccgacccctccccccaacttctcggggactgtgggcgatgtgcgctctgcccactgacgggcaccggagccactcgaactagtcaataatcaatgtcaacgcgtatatctggcccgtacatcgcgacttaagcgctagcggtaccaaaaaatctcgccaacaagttgacgagataaacacggcattttgccttgttttagtagattctgtttccagagtactaaaacnnnnnnnnnnnnnnnnnnnnnnnnnnggtgtttcgtcctttccacaagatatataaagccaagaaatcgaaatactttcaagttacggtaagcatatgatagtccattttaaaacataattttaaaactgcaaactacccaagaaattattactttctacgtcacgtattttgtactaatatctttgtgtttacagtcaaattaattctaattatctctctaacagccttgtatcgtatatgcaaatatgaaggaatcatgggaaataggccctcttcctgcccgaccttccttcgatcgaactaagtcgaaaaaatctcgccaacaagttgacgagataaacacggcattttgccttgttttagtagattctgtttccagagtactaaaacnnnnnnnnnnnnnnnnnnnnnnnnnnggtgtttcgtcctttccacaagatatataaagccaagaaatcgaaatactttcaagttacggtaagcatatgatagtccattttaaaacataattttaaaactgcaaactacccaagaaattattactttctacgtcacgtattttgtactaatatctttgtgtttacagtcaaattaattctaattatctctctaacagccttgtatcgtatatgcaaatatgaaggaatcatgggaaataggccctcttcctgcccgaccttggtaccgaattcagatctgaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaa

SEQ ID NO: 447 - DNA, 4862 bp, Artificial Sequence
  Exemplary recombinant AAV genome containing CRK1 promoter (3'->5' lower strand)
  misc_feature (4409)..(4434): a, c, g, or t
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctagatctctccccagcatgcatttaaatctagagttaacgccttttgctggccttttgctcacatgttctttcctgcgaagcttggacgcgcctgatcaaaaaaccaacacacgcttccaatgaaaataaacgatcctttattgctacttgtcatcgtcatccttgtaatcgatgtcatgatctttataatcaccgtcatggtctttgtagtcgctcgagactttcctcttcttcttgggggatccgccctttttgataatctgagggtgctttttgctcttcacctcatacaggtttcccagaatgtcggttgagtactttttgatactctgagtcttagaggcaattgttttgataattcgaggggggcgcttatcattcatgttttccagatactctcggtaagtgatgtcaatcatattcacttcaatgcggttcagcagatcattgttcaccccgatgaccctatacagttcgccattgatcttaatcaggtcgttgttgtaaaaggaggcgatgaactctgcctggttgctaatctttttcagctttttagcctcttcgtagcacttgctattcacttcatagtagttctcctttttgatgacatccagattcttgacagtcacaaatttatacacgccgttgtccagatagacatcgaatctgtatggcttcagtgacagcttgaccaccttgttgcgactgttagggtaatcgtctgtgatgtccagatgggcattcagcttgttcccatagtacttgatcttcttgatcacggggccattatcctttttgctatacttggtcaggtagttcccagtctcttcatagtacttatacagtgggttcttctcgtcgccgtactgctccataatcagcttcagtttctgatatgtctgaggatcatggtggtacatcagcagcttctcgggacttttgttgatcagctttttcagcttgtcattatctttgtcgtacagtccgttcagattgttcacaatcagggtattccccttatcgtcttttcttgtactatacagggtgtcattgatcagctctctgttgggctttttatccacccggtgagagtacttgtagtccttgaaatccttgatatgcttgatctggtgaggagtgatgaaaatctccttgtactcctgttctgtctcgatttcgggcatagattcggcctgcttctcttcgaacatctggttctccatcactttcttggctttgtccagctttttccactccttaaagatgaagtcggcatttgcgataatcagagcatcttcggcatggtgcttgtaccctttgttgcgctcctttttaaacttccatttgcgcctcagaaaagatgtgaacccgccgttgatggacttgactttcacatccagattgttcacccggaaataggatcgcagcagattcatcaggccgcgagtagcgtatcttgtgtccaccagattccggttaataaaatccttctggacggagaatctgttgatgtcccgctcttccagcaggtactcctttttggtcttgctgatgcggccctttcctttggccagattcagaatgtgctttttaaaggtttcgtaagagatcttggaatctgaactagacaggtactggaaaggagtcctattgccctttttagagttctcttcctgcttgaccagcaccttgttgttaaaggaattgtcgaaggacacgcttctggggataatatgatcgacctcgtagttgaatggattgttcagcaggtcctccagggggatggcctccagagaatacagacactttccctcctgcatatcgtgcagcttgattttttcaatcaggtactttgcgttctctttcccggtagttcggataatctcttcaatgcgttcattggtctgccggtttcgtttctgcatctcattgatcatcttctgtgcgtccttgctgttcttctccctagccagctcgataatgatatcattgggcaggccgtacttcttgatgatggcgttgatcactttgatgctctggatgaagctccgcttgaccacgggtgacagaatgaaatcgtccaccagtgtggttgggatctctttctgctgactcaggtccaccttttttgggaccagcttcagccggttaaagattgcaatctgattgtcgtttgtatgccacagctcatccagaatcagattgatagctttcagggacaggttgtgtgttccggtgtaccccttcagattactaatctgttcgatctcttcctgggtcagctcgctgttcaggttagtcagctcttcctggatgtcctcggagctctggtagatagtcaggatcttagcaatctgatccagcagttcggcgttctcaatgatttctttccgtgctgtgatgtccttaatatcgtgatacactttcagattggtgaactctggttttccagtgcttgtcacccggtagcccttgatgtcctcttcgttgaccaggatctccttagcaatctgtttcagtgtaggctttttcttctgcttaaacacgttttcgatgatctggaacttctcatagtattccagtttctcgttttcatccctggtgatgaccaggttgttcaggtcattcagggcgttgtacagatctgcgttataagcgtacttgacgcttctcagctcttctggaaaataggtgcaatgtcccatcagcatctcgtaccattccttgatgtctttccatccgaaggggctcccttctcctggtccctcatagtaggttctccgagtctccagcaggtcgatataagtatcgatgaagctctgatccagctggtggtaagccttctgcactttcagcagctgcttggcttctttgacgtagtcgcttgtcttgaacctattaattgaccctctcacctcgccatctttcttcagccgttccagctgcagctctgcgacatacttctcttccagagctttgctattgcgtgagatctgttcctttgtagacagctcgttgccggtgtcctcttccacctcattgacgttatgcactcctcggcgcttagccaggtgcagcagagctgcggaaaactcttcctctgacagcttctgactcaggcctttcaccctggcttcataaggattaattccactcagctcagaatggtcggtcagcaggttgtaatcgaacagcagtttcttcaccctctggattctgtgccttctccgtcgtttcaggcgcctggctcccctcttgcttctccgtccctcattgttttccacgttggcctccttgaacagtctgacgcctgcgtcgatcacgtcccttgtttcatagtcaataatcccataccccacgcttgtaatcccgatgtccagccccagaatgtagttccttttcatggacgcttcgaccttgcgctttttcttcggcatggtggcggctctccctatagtgagtcgtattagcggccgcgcccttggcctgtggcccgtccctgcccttgctggacgagagagaccgggccctgtcgagggttcctggggaccactgggaagcccctgggagaccggggctgacacagcaccaggcgaaatcccagccggggtcacggaggacgcttaggagtggcaagaaggtgctagaaaaagacaatcccctgagctgcttggaatccgattagatcattctgcccggccccttcctccaaggggccgcctcacttttcccctgagaaggacaaacaaccaccaggcttctggggcccactagtcaataatcaatgtcaacgcgtatatctggcccgtacatcgcgacttaagcgctagcggtaccaaaaaatctcgccaacaagttgacgagataaacacggcattttgccttgttttagtagatggtgtttcgtcctttccacaagatatataaagccaagaaatcgaaatactttcaagttacggtaagcatatgatagtccattttaaaacataattttaaaactgcaaactacccaagaaattattactttctacgtcacgtattttgtactaatatctttgtgtttacagtcaaattaattctaattatctctctaacagccttgtatcgtatatgcaaatatgaaggaatcatgggaaataggccctcttcctgcccgaccttccttcgatcgaactaagtcgaaaaaatctcgccaacaagttgacgagataaacacggcattttgccttgttttagtagattctgtttccagagtactaaaacnnnnnnnnnnnnnnnnnnnnnnnnnnggtgtttcgtcctttccacaagatatataaagccaagaaatcgaaatactttcaagttacggtaagcatatgatagtccattttaaaacataattttaaaactgcaaactacccaagaaattattactttctacgtcacgtattttgtactaatatctttgtgtttacagtcaaattaattctaattatctctctaacagccttgtatcgtatatgcaaatatgaaggaatcatgggaaataggccctcttcctgcccgaccttggtaccgaattcagatctgaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaa

SEQ ID NO: 448 - DNA, 4731 bp, Artificial Sequence
  Exemplary recombinant AAV genome containing CRX promoter (3'->5' lower strand)
  misc_feature (3886)..(3911): a, c, g, or t
  misc_feature (4278)..(4303): a, c, g, or t
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctagatctctccccagcatgcatttaaatctagagttaacgccttttgctggccttttgctcacatgttctttcctgcgaagcttggacgcgcctgatcaaaaaaccaacacacgcttccaatgaaaataaacgatcctttattgctacttgtcatcgtcatccttgtaatcgatgtcatgatctttataatcaccgtcatggtctttgtagtcgctcgagactttcctcttcttcttgggggatccgccctttttgataatctgagggtgctttttgctcttcacctcatacaggtttcccagaatgtcggttgagtactttttgatactctgagtcttagaggcaattgttttgataattcgaggggggcgcttatcattcatgttttccagatactctcggtaagtgatgtcaatcatattcacttcaatgcggttcagcagatcattgttcaccccgatgaccctatacagttcgccattgatcttaatcaggtcgttgttgtaaaaggaggcgatgaactctgcctggttgctaatctttttcagctttttagcctcttcgtagcacttgctattcacttcatagtagttctcctttttgatgacatccagattcttgacagtcacaaatttatacacgccgttgtccagatagacatcgaatctgtatggcttcagtgacagcttgaccaccttgttgcgactgttagggtaatcgtctgtgatgtccagatgggcattcagcttgttcccatagtacttgatcttcttgatcacggggccattatcctttttgctatacttggtcaggtagttcccagtctcttcatagtacttatacagtgggttcttctcgtcgccgtactgctccataatcagcttcagtttctgatatgtctgaggatcatggtggtacatcagcagcttctcgggacttttgttgatcagctttttcagcttgtcattatctttgtcgtacagtccgttcagattgttcacaatcagggtattccccttatcgtcttttcttgtactatacagggtgtcattgatcagctctctgttgggctttttatccacccggtgagagtacttgtagtccttgaaatccttgatatgcttgatctggtgaggagtgatgaaaatctccttgtactcctgttctgtctcgatttcgggcatagattcggcctgcttctcttcgaacatctggttctccatcactttcttggctttgtccagctttttccactccttaaagatgaagtcggcatttgcgataatcagagcatcttcggcatggtgcttgtaccctttgttgcgctcctttttaaacttccatttgcgcctcagaaaagatgtgaacccgccgttgatggacttgactttcacatccagattgttcacccggaaataggatcgcagcagattcatcaggccgcgagtagcgtatcttgtgtccaccagattccggttaataaaatccttctggacggagaatctgttgatgtcccgctcttccagcaggtactcctttttggtcttgctgatgcggccctttcctttggccagattcagaatgtgctttttaaaggtttcgtaagagatcttggaatctgaactagacaggtactggaaaggagtcctattgccctttttagagttctcttcctgcttgaccagcaccttgttgttaaaggaattgtcgaaggacacgcttctggggataatatgatcgacctcgtagttgaatggattgttcagcaggtcctccagggggatggcctccagagaatacagacactttccctcctgcatatcgtgcagcttgattttttcaatcaggtactttgcgttctctttcccggtagttcggataatctcttcaatgcgttcattggtctgccggtttcgtttctgcatctcattgatcatcttctgtgcgtccttgctgttcttctccctagccagctcgataatgatatcattgggcaggccgtacttcttgatgatggcgttgatcactttgatgctctggatgaagctccgcttgaccacgggtgacagaatgaaatcgtccaccagtgtggttgggatctctttctgctgactcaggtccaccttttttgggaccagcttcagccggttaaagattgcaatctgattgtcgtttgtatgccacagctcatccagaatcagattgatagctttcagggacaggttgtgtgttccggtgtaccccttcagattactaatctgttcgatctcttcctgggtcagctcgctgttcaggttagtcagctcttcctggatgtcctcggagctctggtagatagtcaggatcttagcaatctgatccagcagttcggcgttctcaatgatttctttccgtgctgtgatgtccttaatatcgtgatacactttcagattggtgaactctggttttccagtgcttgtcacccggtagcccttgatgtcctcttcgttgaccaggatctccttagcaatctgtttcagtgtaggctttttcttctgcttaaacacgttttcgatgatctggaacttctcatagtattccagtttctcgttttcatccctggtgatgaccaggttgttcaggtcattcagggcgttgtacagatctgcgttataagcgtacttgacgcttctcagctcttctggaaaataggtgcaatgtcccatcagcatctcgtaccattccttgatgtctttccatccgaaggggctcccttctcctggtccctcatagtaggttctccgagtctccagcaggtcgatataagtatcgatgaagctctgatccagctggtggtaagccttctgcactttcagcagctgcttggcttctttgacgtagtcgcttgtcttgaacctattaattgaccctctcacctcgccatctttcttcagccgttccagctgcagctctgcgacatacttctcttccagagctttgctattgcgtgagatctgttcctttgtagacagctcgttgccggtgtcctcttccacctcattgacgttatgcactcctcggcgcttagccaggtgcagcagagctgcggaaaactcttcctctgacagcttctgactcaggcctttcaccctggcttcataaggattaattccactcagctcagaatggtcggtcagcaggttgtaatcgaacagcagtttcttcaccctctggattctgtgccttctccgtcgtttcaggcgcctggctcccctcttgcttctccgtccctcattgttttccacgttggcctccttgaacagtctgacgcctgcgtcgatcacgtcccttgtttcatagtcaataatcccataccccacgcttgtaatcccgatgtccagccccagaatgtagttccttttcatggacgcttcgaccttgcgctttttcttcggcatggtggcggctctccctatagtgagtcgtattagcggccgccgcccggtaatccctccttgtggctgggtcattgtgtctcagccataaggggccctttctttctcctcctccctcccccaaaccccctgctaggagagattaaggctacaggcactagtcaataatcaatgtcaacgcgtatatctggcccgtacatcgcgacttaagcgctagcggtaccaaaaaatctcgccaacaagttgacgagataaacacggcattttgccttgttttagtagattctgtttccagagtactaaaacnnnnnnnnnnnnnnnnnnnnnnnnnnggtgtttcgtcctttccacaagatatataaagccaagaaatcgaaatactttcaagttacggtaagcatatgatagtccattttaaaacataattttaaaactgcaaactacccaagaaattattactttctacgtcacgtattttgtactaatatctttgtgtttacagtcaaattaattctaattatctctctaacagccttgtatcgtatatgcaaatatgaaggaatcatgggaaataggccctcttcctgcccgaccttccttcgatcgaactaagtcgaaaaaatctcgccaacaagttgacgagataaacacggcattttgccttgttttagtagattctgtttccagagtactaaaacnnnnnnnnnnnnnnnnnnnnnnnnnnggtgtttcgtcctttccacaagatatataaagccaagaaatcgaaatactttcaagttacggtaagcatatgatagtccattttaaaacataattttaaaactgcaaactacccaagaaattattactttctacgtcacgtattttgtactaatatctttgtgtttacagtcaaattaattctaattatctctctaacagccttgtatcgtatatgcaaatatgaaggaatcatgggaaataggccctcttcctgcccgaccttggtaccgaattcagatctgaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaa

SEQ ID NO: 449 - DNA, 4899 bp, Artificial Sequence
  Exemplary recombinant AAV genome containing NRL promoter (3'->5' lower strand)
  misc_feature (4054)..(4079): a, c, g, or t
  misc_feature (4446)..(4471): a, c, g, or t
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctagatctctccccagcatgcatttaaatctagagttaacgccttttgctggccttttgctcacatgttctttcctgcgaagcttggacgcgcctgatcaaaaaaccaacacacgcttccaatgaaaataaacgatcctttattgctacttgtcatcgtcatccttgtaatcgatgtcatgatctttataatcaccgtcatggtctttgtagtcgctcgagactttcctcttcttcttgggggatccgccctttttgataatctgagggtgctttttgctcttcacctcatacaggtttcccagaatgtcggttgagtactttttgatactctgagtcttagaggcaattgttttgataattcgaggggggcgcttatcattcatgttttccagatactctcggtaagtgatgtcaatcatattcacttcaatgcggttcagcagatcattgttcaccccgatgaccctatacagttcgccattgatcttaatcaggtcgttgttgtaaaaggaggcgatgaactctgcctggttgctaatctttttcagctttttagcctcttcgtagcacttgctattcacttcatagtagttctcctttttgatgacatccagattcttgacagtcacaaatttatacacgccgttgtccagatagacatcgaatctgtatggcttcagtgacagcttgaccaccttgttgcgactgttagggtaatcgtctgtgatgtccagatgggcattcagcttgttcccatagtacttgatcttcttgatcacggggccattatcctttttgctatacttggtcaggtagttcccagtctcttcatagtacttatacagtgggttcttctcgtcgccgtactgctccataatcagcttcagtttctgatatgtctgaggatcatggtggtacatcagcagcttctcgggacttttgttgatcagctttttcagcttgtcattatctttgtcgtacagtccgttcagattgttcacaatcagggtattccccttatcgtcttttcttgtactatacagggtgtcattgatcagctctctgttgggctttttatccacccggtgagagtacttgtagtccttgaaatccttgatatgcttgatctggtgaggagtgatgaaaatctccttgtactcctgttctgtctcgatttcgggcatagattcggcctgcttctcttcgaacatctggttctccatcactttcttggctttgtccagctttttccactccttaaagatgaagtcggcatttgcgataatcagagcatcttcggcatggtgcttgtaccctttgttgcgctcctttttaaacttccatttgcgcctcagaaaagatgtgaacccgccgttgatggacttgactttcacatccagattgttcacccggaaataggatcgcagcagattcatcaggccgcgagtagcgtatcttgtgtccaccagattccggttaataaaatccttctggacggagaatctgttgatgtcccgctcttccagcaggtactcctttttggtcttgctgatgcggccctttcctttggccagattcagaatgtgctttttaaaggtttcgtaagagatcttggaatctgaactagacaggtactggaaaggagtcctattgccctttttagagttctcttcctgcttgaccagcaccttgttgttaaaggaattgtcgaaggacacgcttctggggataatatgatcgacctcgtagttgaatggattgttcagcaggtcctccagggggatggcctccagagaatacagacactttccctcctgcatatcgtgcagcttgattttttcaatcaggtactttgcgttctctttcccggtagttcggataatctcttcaatgcgttcattggtctgccggtttcgtttctgcatctcattgatcatcttctgtgcgtccttgctgttcttctccctagccagctcgataatgatatcattgggcaggccgtacttcttgatgatggcgttgatcactttgatgctctggatgaagctccgcttgaccacgggtgacagaatgaaatcgtccaccagtgtggttgggatctctttctgctgactcaggtccaccttttttgggaccagcttcagccggttaaagattgcaatctgattgtcgtttgtatgccacagctcatccagaatcagattgatagctttcagggacaggttgtgtgttccggtgtaccccttcagattactaatctgttcgatctcttcctgggtcagctcgctgttcaggttagtcagctcttcctggatgtcctcggagctctggtagatagtcaggatcttagcaatctgatccagcagttcggcgttctcaatgatttctttccgtgctgtgatgtccttaatatcgtgatacactttcagattggtgaactctggttttccagtgcttgtcacccggtagcccttgatgtcctcttcgttgaccaggatctccttagcaatctgtttcagtgtaggctttttcttctgcttaaacacgttttcgatgatctggaacttctcatagtattccagtttctcgttttcatccctggtgatgaccaggttgttcaggtcattcagggcgttgtacagatctgcgttataagcgtacttgacgcttctcagctcttctggaaaataggtgcaatgtcccatcagcatctcgtaccattccttgatgtctttccatccgaaggggctcccttctcctggtccctcatagtaggttctccgagtctccagcaggtcgatataagtatcgatgaagctctgatccagctggtggtaagccttctgcactttcagcagctgcttggcttctttgacgtagtcgcttgtcttgaacctattaattgaccctctcacctcgccatctttcttcagccgttccagctgcagctctgcgacatacttctcttccagagctttgctattgcgtgagatctgttcctttgtagacagctcgttgccggtgtcctcttccacctcattgacgttatgcactcctcggcgcttagccaggtgcagcagagctgcggaaaactcttcctctgacagcttctgactcaggcctttcaccctggcttcataaggattaattccactcagctcagaatggtcggtcagcaggttgtaatcgaacagcagtttcttcaccctctggattctgtgccttctccgtcgtttcaggcgcctggctcccctcttgcttctccgtccctcattgttttccacgttggcctccttgaacagtctgacgcctgcgtcgatcacgtcccttgtttcatagtcaataatcccataccccacgcttgtaatcccgatgtccagccccagaatgtagttccttttcatggacgcttcgaccttgcgctttttcttcggcatggtggcggctctccctatagtgagtcgtattagcggccgcttaagcgggtcgctgcagggtcgctcggtgttcgaggccacacgcgtcaccttaatatgcgaatgtgtgtgtctctgcccctctctcctctctcactcattctagttcccagatggctgaggggtgacctacattttcagcctaatcccctaacacctcttagagctatcatccctgagtaggagtgggaacagggatactaggaattatccaaggagatgtttaaacctgtccgaagctgtttaaatagggtctatggagttaaaggccacttcctacctactagtcaataatcaatgtcaacgcgtatatctggcccgtacatcgcgacttaagcgctagcggtaccaaaaaatctcgccaacaagttgacgagataaacacggcattttgccttgttttagtagattctgtttccagagtactaaaacnnnnnnnnnnnnnnnnnnnnnnnnnnggtgtttcgtcctttccacaagatatataaagccaagaaatcgaaatactttcaagttacggtaagcatatgatagtccattttaaaacataattttaaaactgcaaactacccaagaaattattactttctacgtcacgtattttgtactaatatctttgtgtttacagtcaaattaattctaattatctctctaacagccttgtatcgtatatgcaaatatgaaggaatcatgggaaataggccctcttcctgcccgaccttccttcgatcgaactaagtcgaaaaaatctcgccaacaagttgacgagataaacacggcattttgccttgttttagtagattctgtttccagagtactaaaacnnnnnnnnnnnnnnnnnnnnnnnnnnggtgtttcgtcctttccacaagatatataaagccaagaaatcgaaatactttcaagttacggtaagcatatgatagtccattttaaaacataattttaaaactgcaaactacccaagaaattattactttctacgtcacgtattttgtactaatatctttgtgtttacagtcaaattaattctaattatctctctaacagccttgtatcgtatatgcaaatatgaaggaatcatgggaaataggccctcttcctgcccgaccttggtaccgaattcagatctgaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaa

SEQ ID NO: 450 - DNA, 4853 bp, Artificial Sequence
  Exemplary recombinant AAV genome containing NRL promoter (3'->5' lower strand)
  misc_feature (4008)..(4033): a, c, g, or t
  misc_feature (4400)..(4425): a, c, g, or t
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctagatctctccccagcatgcatttaaatctagagttaacgccttttgctggccttttgctcacatgttctttcctgcgaagcttggacgcgcctgatcaaaaaaccaacacacgcttccaatgaaaataaacgatcctttattgctacttgtcatcgtcatccttgtaatcgatgtcatgatctttataatcaccgtcatggtctttgtagtcgctcgagactttcctcttcttcttgggggatccgccctttttgataatctgagggtgctttttgctcttcacctcatacaggtttcccagaatgtcggttgagtactttttgatactctgagtcttagaggcaattgttttgataattcgaggggggcgcttatcattcatgttttccagatactctcggtaagtgatgtcaatcatattcacttcaatgcggttcagcagatcattgttcaccccgatgaccctatacagttcgccattgatcttaatcaggtcgttgttgtaaaaggaggcgatgaactctgcctggttgctaatctttttcagctttttagcctcttcgtagcacttgctattcacttcatagtagttctcctttttgatgacatccagattcttgacagtcacaaatttatacacgccgttgtccagatagacatcgaatctgtatggcttcagtgacagcttgaccaccttgttgcgactgttagggtaatcgtctgtgatgtccagatgggcattcagcttgttcccatagtacttgatcttcttgatcacggggccattatcctttttgctatacttggtcaggtagttcccagtctcttcatagtacttatacagtgggttcttctcgtcgccgtactgctccataatcagcttcagtttctgatatgtctgaggatcatggtggtacatcagcagcttctcgggacttttgttgatcagctttttcagcttgtcattatctttgtcgtacagtccgttcagattgttcacaatcagggtattccccttatcgtcttttcttgtactatacagggtgtcattgatcagctctctgttgggctttttatccacccggtgagagtacttgtagtccttgaaatccttgatatgcttgatctggtgaggagtgatgaaaatctccttgtactcctgttctgtctcgatttcgggcatagattcggcctgcttctcttcgaacatctggttctccatcactttcttggctttgtccagctttttccactccttaaagatgaagtcggcatttgcgataatcagagcatcttcggcatggtgcttgtaccctttgttgcgctcctttttaaacttccatttgcgcctcagaaaagatgtgaacccgccgttgatggacttgactttcacatccagattgttcacccggaaataggatcgcagcagattcatcaggccgcgagtagcgtatcttgtgtccaccagattccggttaataaaatccttctggacggagaatctgttgatgtcccgctcttccagcaggtactcctttttggtcttgctgatgcggccctttcctttggccagattcagaatgtgctttttaaaggtttcgtaagagatcttggaatctgaactagacaggtactggaaaggagtcctattgccctttttagagttctcttcctgcttgaccagcaccttgttgttaaaggaattgtcgaaggacacgcttctggggataatatgatcgacctcgtagttgaatggattgttcagcaggtcctccagggggatggcctccagagaatacagacactttccctcctgcatatcgtgcagcttgattttttcaatcaggtactttgcgttctctttcccggtagttcggataatctcttcaatgcgttcattggtctgccggtttcgtttctgcatctcattgatcatcttctgtgcgtccttgctgttcttctccctagccagctcgataatgatatcattgggcaggccgtacttcttgatgatggcgttgatcactttgatgctctggatgaagctccgcttgaccacgggtgacagaatgaaatcgtccaccagtgtggttgggatctctttctgctgactcaggtccaccttttttgggaccagcttcagccggttaaagattgcaatctgattgtcgtttgtatgccacagctcatccagaatcagattgatagctttcagggacaggttgtgtgttccggtgtaccccttcagattactaatctgttcgatctcttcctgggtcagctcgctgttcaggttagtcagctcttcctggatgtcctcggagctctggtagatagtcaggatcttagcaatctgatccagcagttcggcgttctcaatgatttctttccgtgctgtgatgtccttaatatcgtgatacactttcagattggtgaactctggttttccagtgcttgtcacccggtagcccttgatgtcctcttcgttgaccaggatctccttagcaatctgtttcagtgtaggctttttcttctgcttaaacacgttttcgatgatctggaacttctcatagtattccagtttctcgttttcatccctggtgatgaccaggttgttcaggtcattcagggcgttgtacagatctgcgttataagcgtacttgacgcttctcagctcttctggaaaataggtgcaatgtcccatcagcatctcgtaccattccttgatgtctttccatccgaaggggctcccttctcctggtccctcatagtaggttctccgagtctccagcaggtcgatataagtatcgatgaagctctgatccagctggtggtaagccttctgcactttcagcagctgcttggcttctttgacgtagtcgcttgtcttgaacctattaattgaccctctcacctcgccatctttcttcagccgttccagctgcagctctgcgacatacttctcttccagagctttgctattgcgtgagatctgttcctttgtagacagctcgttgccggtgtcctcttccacctcattgacgttatgcactcctcggcgcttagccaggtgcagcagagctgcggaaaactcttcctctgacagcttctgactcaggcctttcaccctggcttcataaggattaattccactcagctcagaatggtcggtcagcaggttgtaatcgaacagcagtttcttcaccctctggattctgtgccttctccgtcgtttcaggcgcctggctcccctcttgcttctccgtccctcattgttttccacgttggcctccttgaacagtctgacgcctgcgtcgatcacgtcccttgtttcatagtcaataatcccataccccacgcttgtaatcccgatgtccagccccagaatgtagttccttttcatggacgcttcgaccttgcgctttttcttcggcatggtggcggctctccctatagtgagtcgtattagcggccgctgagtgaggaagagtgggcagcggctggggagtcgctgggtgggtgggacgtgcgtggtcccctggccgcaggctgggctcaaggctggtgtgagctgaagaccgagatgctggtggcttaggaggatttgcgaccagttcttcgcaatccttgaagggaggaggggcccaggagctttgtggagggcgggagcggtgggggggggtgctcccagaaccctagtgagattaaaatactagtcaataatcaatgtcaacgcgtatatctggcccgtacatcgcgacttaagcgctagcggtaccaaaaaatctcgccaacaagttgacgagataaacacggcattttgccttgttttagtagattctgtttccagagtactaaaacnnnnnnnnnnnnnnnnnnnnnnnnnnggtgtttcgtcctttccacaagatatataaagccaagaaatcgaaatactttcaagttacggtaagcatatgatagtccattttaaaacataattttaaaactgcaaactacccaagaaattattactttctacgtcacgtattttgtactaatatctttgtgtttacagtcaaattaattctaattatctctctaacagccttgtatcgtatatgcaaatatgaaggaatcatgggaaataggccctcttcctgcccgaccttccttcgatcgaactaagtcgaaaaaatctcgccaacaagttgacgagataaacacggcattttgccttgttttagtagattctgtttccagagtactaaaacnnnnnnnnnnnnnnnnnnnnnnnnnnggtgtttcgtcctttccacaagatatataaagccaagaaatcgaaatactttcaagttacggtaagcatatgatagtccattttaaaacataattttaaaactgcaaactacccaagaaattattactttctacgtcacgtattttgtactaatatctttgtgtttacagtcaaattaattctaattatctctctaacagccttgtatcgtatatgcaaatatgaaggaatcatgggaaataggccctcttcctgcccgaccttggtaccgaattcagatctgaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaa

SEQ ID NO: 451 - protein, 8 aa, Artificial Sequence
  Flag tag (single)
DYKDDDDK

SEQ ID NO: 452 - protein, 9 aa, Artificial Sequence
  HA tag
YPYDVPDYA

SEQ ID NO: 453 - protein, 10 aa, Artificial Sequence
  Myc tag
EQKLISEEDL

SEQ ID NO: 454 - protein, 6 aa, Artificial Sequence
  His tag
HHHHHH

SEQ ID NO: 455 - DNA, 228 bp, Artificial Sequence
  bGH polyA
gctgcaggatgaccggtcatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggaca

SEQ ID NO: 456 - DNA, 134 bp, Artificial Sequence
  SV40 polyA
atgctttatttgtgaaatttgtgatgctattgctttatttgtaaccattataagctgcaataaacaagttaacaacaacaattgcattcattttatgtttcaggttcagggggaggtgtgggaggttttttaaa

SEQ ID NO: 457 - RNA, 17 nt, Artificial Sequence
  CEP290-B8/-89 targeting domain (RNA)
gcuaccgguuaccugaa

SEQ ID NO: 458 - RNA, 17 nt, Artificial Sequence
  CEP290-B217/-B1074/-86 targeting domain (RNA)
gcagaacuaguguagac

SEQ ID NO: 459 - RNA, 17 nt, Artificial Sequence
  CEP290-B69/-114 targeting domain (RNA)
guugaguaucuccuguu

SEQ ID NO: 460 - RNA, 20 nt, Artificial Sequence
  CEP290-496/-B115/-B1041/-85 targeting domain (RNA)
gaugcagaacuaguguagac

SEQ ID NO: 461 - RNA, 20 nt, Artificial Sequence
  CEP290-B187/-B1045/-91/-1505 targeting domain (RNA)
gcuugaacucugugccaaac

SEQ ID NO: 462 - RNA, 20 nt, Artificial Sequence
  CEP290-B473/-B1035/-67/-956 targeting domain (RNA)
gaaagaugaaaaauacucuu

SEQ ID NO: 463 - RNA, 17 nt, Artificial Sequence
  CEP290-68 targeting domain (RNA)
gaaauagauguagauug

SEQ ID NO: 464 - RNA, 20 nt, Artificial Sequence
  CEP290-70 targeting domain (RNA)
gaaauauuaagggcucuucc

SEQ ID NO: 465 - RNA, 20 nt, Artificial Sequence
  CEP290-71/-969 targeting domain (RNA)
gaacaaaagccagggaccau

SEQ ID NO: 466 - RNA, 20 nt, Artificial Sequence
  CEP290-B459/-72 targeting domain
gaacucuauaccuuuuacug

SEQ ID NO: 467 - RNA, 20 nt, Artificial Sequence
  CEP290-73/-1554 targeting domain (RNA)
gaagaauggaauagauaaua

SEQ ID NO: 468 - RNA, 20 nt, Artificial Sequence
  CEP290-74/-490 targeting domain (RNA)
gaauaguuuguucuggguac

SEQ ID NO: 469 - RNA, 17 nt, Artificial Sequence
  CEP290-75 targeting domain (RNA)
gaauggaauagauaaua

SEQ ID NO: 470 - RNA, 20 nt, Artificial Sequence
  CEP290-76 targeting domain (RNA)
gaauuuacagagugcaucca

SEQ ID NO: 471 - RNA, 20 nt, Artificial Sequence
  CEP290-77 targeting domain (RNA)
gagaaaaaggagcaugaaac

SEQ ID NO: 472 - RNA, 17 nt, Artificial Sequence
  CEP290-B283/-78 targeting domain (RNA)
gagagccacagugcaug

SEQ ID NO: 473 - RNA, 17 nt, Artificial Sequence
  CEP290-79 targeting domain (RNA)
gagguagaaucaagaag

SEQ ID NO: 474 - RNA, 17 nt, Artificial Sequence
  CEP290-80 targeting domain
gagugcauccauggucc

SEQ ID NO: 475 - RNA, 17 nt, Artificial Sequence
  CEP290-81 targeting domain (RNA)
gauaacuacaaaggguc

SEQ ID NO: 476 - RNA, 17 nt, Artificial Sequence
  CEP290-82/-B292 targeting domain (RNA)
gauagagacaggaauaa

SEQ ID NO: 477 - RNA, 17 nt, Artificial Sequence
  CEP290-B445/-B1069/-83 targeting domain (RNA)
gaugaaaaauacucuuu

SEQ ID NO: 478 - RNA, 17 nt, Artificial Sequence
  CEP290-B50/-B1070/-84 targeting domain (RNA)
gaugacaugagguaagu

SEQ ID NO: 479 - RNA, 17 nt, Artificial Sequence
  CEP290-B87/-87 targeting domain (RNA)
gcauguggugucaaaua

SEQ ID NO: 480 - RNA, 20 nt, Artificial Sequence
  CEP290-B182/-B1044/-88/-500 targeting domain (RNA)
gccugaacaaguuuugaaac

SEQ ID NO: 481 - RNA, 17 nt, Artificial Sequence
  CEP290-B85/-B1075/-90 targeting domain (RNA)
gcucuuuucuauauaua

SEQ ID NO: 482 - RNA, 20 nt, Artificial Sequence
  CEP290-B241/-B1048/-92/-1524 targeting domain (RNA)
gcuuuugacaguuuuuaagg

SEQ ID NO: 483 - RNA, 17 nt, Artificial Sequence
  CEP290-93 targeting domain (RNA)
gcuuuuguuccuuggaa

SEQ ID NO: 484 - RNA, 20 nt, Artificial Sequence
  CEP290-94/-1283 targeting domain (RNA)
ggaacaaaagccagggacca

SEQ ID NO: 485 - RNA, 20 nt, Artificial Sequence
  CEP290-B278/-95 targeting domain (RNA)
ggacuugacuuuuacccuuc

SEQ ID NO: 486 - RNA, 17 nt, Artificial Sequence
  CEP290-96 targeting domain (RNA)
ggagaauaguuuguucu

SEQ ID NO: 487 - RNA, 20 nt, Artificial Sequence
  CEP290-B67/-97 targeting domain (RNA)
ggagucacaugggagucaca

SEQ ID NO: 488 - RNA, 17 nt, Artificial Sequence
  CEP290-B444/-B1076/-98 targeting domain (RNA)
ggauaggacagaggaca

SEQ ID NO: 489 - RNA, 20 nt, Artificial Sequence
  CEP290-99 targeting domain (RNA)
ggcuguaagauaacuacaaa

SEQ ID NO: 490 - RNA, 17 nt, Artificial Sequence
  CEP290-100 targeting domain (RNA)
gggagaauaguuuguuc

SEQ ID NO: 491 - RNA, 20 nt, Artificial Sequence
  CEP290-B227/-101 targeting domain (RNA)
gggagucacaugggagucac

SEQ ID NO: 492 - RNA, 17 nt, Artificial Sequence
  CEP290-102 targeting domain (RNA)
gggcucuuccuggacca

SEQ ID NO: 493 - RNA, 20 nt, Artificial Sequence
  CEP290-103 targeting domain (RNA)
ggguacagggguaagagaaa

SEQ ID NO: 494 - RNA, 20 nt, Artificial Sequence
  CEP290-104/-489 targeting domain (RNA)
ggucccuggcuuuuguuccu

SEQ ID NO: 495 - RNA, 20 nt, Artificial Sequence
  CEP290-105 targeting domain (RNA)
guaaagguucaugagacuag

SEQ ID NO: 496 - RNA, 20 nt, Artificial Sequence
  CEP290-B465/-B528/-106 targeting domain (RNA)
guaacauaaucaccucucuu

SEQ ID NO: 497 - RNA, 20 nt, Artificial Sequence
  CEP290-B216/-B1054/-107/-503 targeting domain (RNA)
guaagacuggagauagagac

SEQ ID NO: 498 - RNA, 17 nt, Artificial Sequence
  CEP290-108 targeting domain (RNA)
guacagggguaagagaa

SEQ ID NO: 499 - RNA, 20 nt, Artificial Sequence
  CEP290-B259/-109 targeting domain (RNA)
guagcuuuugacaguuuuua

SEQ ID NO: 500 - RNA, 17 nt, Artificial Sequence
  CEP290-B260/-110 targeting domain (RNA)
gucacaugggagucaca

SEQ ID NO: 501 - RNA, 20 nt, Artificial Sequence
  CEP290-B261/-111 targeting domain (RNA)
guggagagccacagugcaug

SEQ ID NO: 502 - RNA, 17 nt, Artificial Sequence
  CEP290-112 targeting domain (RNA)
guuacaaucugugaaua

SEQ ID NO: 503 - RNA, 17 nt, Artificial Sequence
  CEP290-B436/-113 targeting domain (RNA)
guucuguccucaguaaa

SEQ ID NO: 504 - RNA, 20 nt, Artificial Sequence
  CEP290-B161/-115 targeting domain (RNA)
guuuagaaugaucauucuug

SEQ ID NO: 505 - RNA, 17 nt, Artificial Sequence
  CEP290-116 targeting domain (RNA)
guuuguucuggguacag

SEQ ID NO: 506 - RNA, 20 nt, Artificial Sequence
  CEP290-B2/-117 targeting domain (RNA)
uaaaaacugucaaaagcuac

SEQ ID NO: 507 - RNA, 20 nt, Artificial Sequence
  CEP290-118 targeting domain (RNA)
uaaaagguauagaguucaag

SEQ ID NO: 508 - RNA, 20 nt, Artificial Sequence
  CEP290-119/-987 targeting domain (RNA)
uaaaucaugcaagugaccua

SEQ ID NO: 509 - RNA, 20 nt, Artificial Sequence
  CEP290-120 targeting domain (RNA)
uaagauaacuacaaaggguc

SEQ ID NO: 510 - RNA, 17 nt, Artificial Sequence
  CEP290-B1008/-B1059 targeting domain (RNA)
gaauccugaaagcuacu

SEQ ID NO: 511 - RNA, 24 nt, Artificial Sequence
  CEP290-284 targeting domain (RNA)
gcuaaaucaugcaagugaccuaag

SEQ ID NO: 512 - RNA, 19 nt, Artificial Sequence
  CEP290-487 targeting domain (RNA)
ggucacuugcaugauuuag

SEQ ID NO: 513 - RNA, 18 nt, Artificial Sequence
  CEP290-486 targeting domain (RNA)
gucacuugcaugauuuag

SEQ ID NO: 514 - RNA, 23 nt, Artificial Sequence
  CEP290-285 targeting domain (RNA)
gccuaggacuuucuaaugcugga

SEQ ID NO: 515 - RNA, 18 nt, Artificial Sequence
  CEP290-479 targeting domain (RNA)
ggacuuucuaaugcugga

SEQ ID NO: 516 - RNA, 24 nt, Artificial Sequence
  CEP290-286 targeting domain (RNA)
gggaccaugggagaauaguuuguu

SEQ ID NO: 517 - RNA, 23 nt, Artificial Sequence
  CEP290-287 targeting domain (RNA)
ggaccaugggagaauaguuuguu

SEQ ID NO: 518 - RNA, 22 nt, Artificial Sequence
  CEP290-288 targeting domain (RNA)
gaccaugggagaauaguuuguu

SEQ ID NO: 519 - RNA, 24 nt, Artificial Sequence
  CEP290-289 targeting domain (RNA)
ggucccuggcuuuuguuccuugga

SEQ ID NO: 520 - RNA, 23 nt, Artificial Sequence
  CEP290-290 targeting domain (RNA)
gucccuggcuuuuguuccuugga

SEQ ID NO: 521 - RNA, 24 nt, Artificial Sequence
  CEP290-374 targeting domain (RNA)
gaaaacguuguucugaguagcuuu

SEQ ID NO: 522 - RNA, 18 nt, Artificial Sequence
  CEP290-478 targeting domain (RNA)
guuguucugaguagcuuu

SEQ ID NO: 523 - RNA, 19 nt, Artificial Sequence
  CEP290-488 targeting domain (RNA)
gucccuggcuuuuguuccu

SEQ ID NO: 524 - RNA, 23 nt, Artificial Sequence
  CEP290-291 targeting domain (RNA)
gacaucuuguggauaauguauca

SEQ ID NO: 525 - RNA, 21 nt, Artificial Sequence
  CEP290-292 targeting domain (RNA)
guccuaggcaagagacaucuu

SEQ ID NO: 526 - RNA, 23 nt, Artificial Sequence
  CEP290-293 targeting domain (RNA)
gccagcaaaagcuuuugagcuaa

SEQ ID NO: 527 - RNA, 19 nt, Artificial Sequence
  CEP290-481 targeting domain (RNA)
gcaaaagcuuuugagcuaa

SEQ ID NO: 528 - RNA, 21 nt, Artificial Sequence
  CEP290-294 targeting domain (RNA)
gaucuuauucuacuccuguga

SEQ ID NO: 529 - RNA, 23 nt, Artificial Sequence
  CEP290-295 targeting domain (RNA)
gcuuucaggauuccuacuaaauu

SEQ ID NO: 530 - RNA, 22 nt, Artificial Sequence
  CEP290-323 targeting domain (RNA)
guucuguccucaguaaaaggua

SEQ ID NO: 531 - RNA, 18 nt, Artificial Sequence
  CEP290-480 targeting domain (RNA)
gaacaacguuuucauuua

SEQ ID NO: 532 - RNA, 24 nt, Artificial Sequence
  CEP290-296 targeting domain (RNA)
guagaauaucauaaguuacaaucu

SEQ ID NO: 533 - RNA, 21 nt, Artificial Sequence
  CEP290-297 targeting domain (RNA)
gaauaucauaaguuacaaucu

SEQ ID NO: 534 - RNA, 20 nt, Artificial Sequence
  CEP290-298 targeting domain (RNA)
guggcuguaagauaacuaca

SEQ ID NO: 535 - RNA, 18 nt, Artificial Sequence
  CEP290-299 targeting domain (RNA)
ggcuguaagauaacuaca

SEQ ID NO: 536 - RNA, 22 nt, Artificial Sequence
  CEP290-300 targeting domain (RNA)
guuuaacguuaucauuuuccca

SEQ ID NO: 537 - RNA, 24 nt, Artificial Sequence
  CEP290-301 targeting domain (RNA)
guaagagaaagggaugggcacuua

SEQ ID NO: 538 - RNA, 20 nt, Artificial Sequence
  CEP290-492 targeting domain (RNA)
gagaaagggaugggcacuua

SEQ ID NO: 539 - RNA, 18 nt, Artificial Sequence
  CEP290-491 targeting domain (RNA)
gaaagggaugggcacuua

SEQ ID NO: 540 - RNA, 18 nt, Artificial Sequence
  CEP290-483 targeting domain (RNA)
guaaaugaaaacguuguu

SEQ ID NO: 541 - RNA, 24 nt, Artificial Sequence
  CEP290-302 targeting domain (RNA)
gauaaacaugacucauaauuuagu

SEQ ID NO: 542 - RNA, 23 nt, Artificial Sequence
  CEP290-303 targeting domain (RNA)
ggaacaaaagccagggaccaugg

SEQ ID NO: 543 - RNA, 22 nt, Artificial Sequence
  CEP290-304 targeting domain (RNA)
gaacaaaagccagggaccaugg

SEQ ID NO: 544 - RNA, 24 nt, Artificial Sequence
  CEP290-305 targeting domain (RNA)
gggagaauaguuuguucuggguac

SEQ ID NO: 545 - RNA, 23 nt, Artificial Sequence
  CEP290-306 targeting domain (RNA)
ggagaauaguuuguucuggguac

SEQ ID NO: 546 - RNA, 22 nt, Artificial Sequence
  CEP290-307 targeting domain (RNA)
gagaauaguuuguucuggguac

SEQ ID NO: 547 - RNA, 20 nt, Artificial Sequence
  CEP290-B1036/-482 targeting domain (RNA)
gaaauagaggcuuauggauu

SEQ ID NO: 548 - RNA, 24 nt, Artificial Sequence
  CEP290-308 targeting domain (RNA)
guucuggguacagggguaagagaa

SEQ ID NO: 549 - RNA, 19 nt, Artificial Sequence
  CEP290-494 targeting domain (RNA)
ggguacagggguaagagaa

SEQ ID NO: 550 - RNA, 18 nt, Artificial Sequence
  CEP290-493 targeting domain (RNA)
gguacagggguaagagaa

SEQ ID NO: 551 - RNA, 24 nt, Artificial Sequence
  CEP290-309 targeting domain (RNA)
guaaauucucaucauuuuuuauug

SEQ ID NO: 552 - RNA, 24 nt, Artificial Sequence
  CEP290-310 targeting domain (RNA)
ggagaggauaggacagaggacaug

SEQ ID NO: 553 - RNA, 23 nt, Artificial Sequence
  CEP290-311 targeting domain (RNA)
gagaggauaggacagaggacaug

SEQ ID NO: 554 - RNA, 21 nt, Artificial Sequence
  CEP290-313 targeting domain (RNA)
gaggauaggacagaggacaug

SEQ ID NO: 555 - RNA, 19 nt, Artificial Sequence
  CEP290-485 targeting domain (RNA)
ggauaggacagaggacaug

SEQ ID NO: 556 - RNA, 18 nt, Artificial Sequence
  CEP290-484 targeting domain (RNA)
gauaggacagaggacaug

SEQ ID NO: 557 - RNA, 22 nt, Artificial Sequence
  CEP290-314 targeting domain (RNA)
gaauaaauguagaauuuuaaug

SEQ ID NO: 558 - RNA, 22 nt, Artificial Sequence
  CEP290-64 targeting domain (RNA)
gucaaaagcuaccgguuaccug

SEQ ID NO: 559 - RNA, 23 nt, Artificial Sequence
  CEP290-315 targeting domain (RNA)
guuuuuaaggcggggagucacau

SEQ ID NO: 560 - RNA, 24 nt, Artificial Sequence
  CEP290-203 targeting domain (RNA)
gucuuacauccuccuuacugccac

SEQ ID NO: 561 - RNA, 24 nt, Artificial Sequence
  CEP290-316 targeting domain (RNA)
gagucacaggguaggauucauguu

SEQ ID NO: 562 - RNA, 22 nt, Artificial Sequence
  CEP290-317 targeting domain (RNA)
gucacaggguaggauucauguu

SEQ ID NO: 563 - RNA, 24 nt, Artificial Sequence
  CEP290-318 targeting domain (RNA)
ggcacagaguucaagcuaauacau

SEQ ID NO: 564 - RNA, 23 nt, Artificial Sequence
  CEP290-319 targeting domain (RNA)
gcacagaguucaagcuaauacau

SEQ ID NO: 565 - RNA, 18 nt, Artificial Sequence
  CEP290-505 targeting domain (RNA)
gaguucaagcuaauacau

SEQ ID NO: 566 - RNA, 24 nt, Artificial Sequence
  CEP290-320 targeting domain (RNA)
guguugaguaucuccuguuuggca

SEQ ID NO: 567 - RNA, 22 nt, Artificial Sequence
  CEP290-321 targeting domain (RNA)
guugaguaucuccuguuuggca

SEQ ID NO: 568 - RNA, 19 nt, Artificial Sequence
  CEP290-504 targeting domain (RNA)
gaguaucuccuguuuggca

SEQ ID NO: 569 - RNA, 21 nt, Artificial Sequence
  CEP290-322 targeting domain (RNA)
gaaaaucagauuucaugugug

SEQ ID NO: 570 - RNA, 24 nt, Artificial Sequence
  CEP290-324 targeting domain (RNA)
gccacaagaaugaucauucuaaac

SEQ ID NO: 571 - RNA, 23 nt, Artificial Sequence
  CEP290-325 targeting domain (RNA)
ggcggggagucacaugggaguca

SEQ ID NO: 572 - RNA, 22 nt, Artificial Sequence
  CEP290-326 targeting domain (RNA)
gcggggagucacaugggaguca

SEQ ID NO: 573 - RNA, 20 nt, Artificial Sequence
  CEP290-B1051/-499 targeting domain (RNA)
ggggagucacaugggaguca

SEQ ID NO: 574 - RNA, 19 nt, Artificial Sequence
  CEP290-498 targeting domain (RNA)
gggagucacaugggaguca

SEQ ID NO: 575 - RNA, 18 nt, Artificial Sequence
  CEP290-497 targeting domain (RNA)
ggagucacaugggaguca

SEQ ID NO: 576 - RNA, 22 nt, Artificial Sequence
  CEP290-327 targeting domain (RNA)
gcuuuugacaguuuuuaaggcg

SEQ ID NO: 577 - RNA, 21 nt, Artificial Sequence
  CEP290-328 targeting domain (RNA)
gaucauucuuguggcaguaag

SEQ ID NO: 578 - RNA, 18 nt, Artificial Sequence
  CEP290-329 targeting domain (RNA)
gagcaagagaugaacuag

SEQ ID NO: 579 - RNA, 23 nt, Artificial Sequence
  CEP290-330 targeting domain (RNA)
guagauugagguagaaucaagaa

SEQ ID NO: 580 - RNA, 20 nt, Artificial Sequence
  CEP290-506 targeting domain (RNA)
gauugagguagaaucaagaa

SEQ ID NO: 581 - RNA, 24 nt, Artificial Sequence
  CEP290-331 targeting domain (RNA)
ggauguaagacuggagauagagac

SEQ ID NO: 582 - RNA, 23 nt, Artificial Sequence
  CEP290-332 targeting domain (RNA)
gauguaagacuggagauagagac

SEQ ID NO: 583 - RNA, 24 nt, Artificial Sequence
  CEP290-333 targeting domain (RNA)
gggagucacaugggagucacaggg

SEQ ID NO: 584 - RNA, 23 nt, Artificial Sequence
  CEP290-334 targeting domain (RNA)
ggagucacaugggagucacaggg

SEQ ID NO: 585 - RNA, 22 nt, Artificial Sequence
  CEP290-335 targeting domain (RNA)
gagucacaugggagucacaggg

SEQ ID NO: 586 - RNA, 20 nt, Artificial Sequence
  CEP290-502/-B1055 targeting domain (RNA)
gucacaugggagucacaggg

SEQ ID NO: 587 - RNA, 23 nt, Artificial Sequence
  CEP290-336 targeting domain (RNA)
guuuacauaucugucuuccuuaa

SEQ ID NO: 588 - RNA, 18 nt, Artificial Sequence
  CEP290-507 targeting domain (RNA)
gauuucaugugugaagaa

SEQ ID NO: 589 - RNA, 20 nt, Artificial Sequence
  CEP290-B65/-1936 targeting domain (RNA)
gaguucaagcuaauacauga

SEQ ID NO: 590 - RNA, 17 nt, Artificial Sequence
  CEP290-B296/-B536/-1934 targeting domain (RNA)
guuguucugaguagcuu

SEQ ID NO: 591 - RNA, 20 nt, Artificial Sequence
  CEP290-B308/-B482/-1932 targeting domain (RNA)
ggcaaaagcagcagaaagca

SEQ ID NO: 592 - RNA, 17 nt, Artificial Sequence
  CEP290-1933 targeting domain (RNA)
guggcugaaugacuucu

SEQ ID NO: 593 - RNA, 17 nt, Artificial Sequence
  CEP290-1935 targeting domain (RNA)
gacuagaggucacgaaa

SEQ ID NO: 594 - RNA, 17 nt, Artificial Sequence
  CEP290-B6/-B106/-220 targeting domain (RNA)
cucauaccuaucccuau

SEQ ID NO: 595 - RNA, 17 nt, Artificial Sequence
  CEP290-B20/-B55/-152 targeting domain (RNA)
acacugccaauagggau

SEQ ID NO: 596 - RNA, 17 nt, Artificial Sequence
  CEP290-B10 targeting domain (RNA)
caauuacaacuggggcc

SEQ ID NO: 597 - RNA, 17 nt, Artificial Sequence
  CEP290-B21/-B92/-216 targeting domain (RNA)
cuaagacacugccaaua

SEQ ID NO: 598 - RNA, 17 nt, Artificial Sequence
  CEP290-B9/-B1005 targeting domain (RNA)
auacucacaauuacaac

SEQ ID NO: 599 - RNA, 20 nt, Artificial Sequence
  CEP290-B1/-B138 targeting domain (RNA)
uaucucauaccuaucccuau

SEQ ID NO: 600 - RNA, 20 nt, Artificial Sequence
  CEP290-B29/-B253/-140 targeting domain (RNA)
aagacacugccaauagggau

SEQ ID NO: 601 - RNA, 20 nt, Artificial Sequence
  CEP290-B5 targeting domain (RNA)
ucacaauuacaacuggggcc

SEQ ID NO: 602 - RNA, 20 nt, Artificial Sequence
  CEP290-B30 targeting domain (RNA)
agauacucacaauuacaacu

SEQ ID NO: 603 - RNA, 17 nt, Artificial Sequence
  CEP290-B22/-B44/-B1224/-253 targeting domain (RNA)
acuaagacacugccaau

SEQ ID NO: 604 - RNA, 17 nt, Artificial Sequence
  CEP290-B23 targeting domain (RNA)
uacucacaauuacaacu

SEQ ID NO: 605 - RNA, 17 nt, Artificial Sequence
  CEP290-B24 targeting domain (RNA)
acucacaauuacaacug

SEQ ID NO: 606 - RNA, 17 nt, Artificial Sequence
  CEP290-B25 targeting domain (RNA)
acaacuggggccaggug

SEQ ID NO: 607 - RNA, 17 nt, Artificial Sequence
  CEP290-B26 targeting domain (RNA)
acuggggccaggugcgg

SEQ ID NO: 608 - RNA, 17 nt, Artificial Sequence
  CEP290-B27 targeting domain (RNA)
augugagccaccgcacc

SEQ ID NO: 609 - RNA, 20 nt, Artificial Sequence
  CEP290-B31/-B151/-127 targeting domain (RNA)
aaacuaagacacugccaaua

SEQ ID NO: 610 - RNA, 20 nt, Artificial Sequence
  CEP290-B32/-B196/-B1086/-38/-122/-619 targeting domain (RNA)
aaaacuaagacacugccaau

SEQ ID NO: 611 - RNA, 20 nt, Artificial Sequence
  CEP290-B33 targeting domain (RNA)
auuacaacuggggccaggug

SEQ ID NO: 612 - RNA, 20 nt, Artificial Sequence
  CEP290-B34 targeting domain (RNA)
acaacuggggccaggugcgg

SEQ ID NO: 613 - RNA, 20 nt, Artificial Sequence
  CEP290-B1002/-B1131/-509 targeting domain (RNA)
cacugccaauagggauaggu

SEQ ID NO: 614 - RNA, 17 nt, Artificial Sequence
  CEP290-B1003/-B1299 targeting domain (RNA)
ugccaauagggauaggu

SEQ ID NO: 615 - RNA, 20 nt, Artificial Sequence
  CEP290-B1004 targeting domain (RNA)
ugagauacucacaauuacaa

SEQ ID NO: 616 - RNA, 20 nt, Artificial Sequence
  CEP290-B1006/-512 targeting domain (RNA)
accuggccccaguuguaauu

SEQ ID NO: 617 - RNA, 17 nt, Artificial Sequence
  CEP290-B1007 targeting domain (RNA)
uggccccaguuguaauu

SEQ ID NO: 618 - RNA, 17 nt, Artificial Sequence
  CEP290-B269/-166 targeting domain (RNA)
agcuaccgguuaccuga

SEQ ID NO: 619 - RNA, 20 nt, Artificial Sequence
  CEP290-B285/-B1017/-656 targeting domain (RNA)
uuuaaggcggggagucacau

SEQ ID NO: 620 - RNA, 20 nt, Artificial Sequence
  CEP290-B3/-131 targeting domain (RNA)
aaagcuaccgguuaccugaa

SEQ ID NO: 621 - RNA, 20 nt, Artificial Sequence
  CEP290-B207/-124 targeting domain (RNA)
aaaagcuaccgguuaccuga

SEQ ID NO: 622 - RNA, 20 nt, Artificial Sequence
  CEP290-B62/-B1101/-156/-1378 targeting domain (RNA)
acgugcucuuuucuauauau

SEQ ID NO: 623 - RNA, 20 nt, Artificial Sequence
  CEP290-B121/-197 targeting domain (RNA)
auuugacaccacaugcacug

SEQ ID NO: 624 - RNA, 20 nt, Artificial Sequence
  CEP290-B120/-B1149/-214/-1711 targeting domain (RNA)
cgugcucuuuucuauauaua

SEQ ID NO: 625 - RNA, 20 nt, Artificial Sequence
  CEP290-B36/-B1191/-1579 targeting domain (RNA)
uggugucaaauauggugcuu

SEQ ID NO: 626 - RNA, 20 nt, Artificial Sequence
  CEP290-B236/-158 targeting domain (RNA)
acuuuuacccuucagguaac

SEQ ID NO: 627 - RNA, 20 nt, Artificial Sequence
  CEP290-B70/-176 targeting domain (RNA)
agugcauguggugucaaaua

SEQ ID NO: 628 - RNA, 20 nt, Artificial Sequence
  CEP290-B177/-B1166/-1584 targeting domain (RNA)
uacaugagagugauuagugg

SEQ ID NO: 629 - RNA, 20 nt, Artificial Sequence
  CEP290-B451/-B498/-215 targeting domain (RNA)
cguuguucugaguagcuuuc

SEQ ID NO: 630 - RNA, 20 nt, Artificial Sequence
  CEP290-B452/-212 targeting domain (RNA)
ccacaagaugucucuugccu

SEQ ID NO: 631 - RNA, 20 nt, Artificial Sequence
  CEP290-B453/-213 targeting domain (RNA)
ccuaggcaagagacaucuug

SEQ ID NO: 632 - RNA, 20 nt, Artificial Sequence
  CEP290-B454/-B1189/-1006 targeting domain (RNA)
ugccuaggacuuucuaaugc

SEQ ID NO: 633 - RNA, 20 nt, Artificial Sequence
  CEP290-B523/-B456/-193 targeting domain (RNA)
auuagcucaaaagcuuuugc

SEQ ID NO: 634 - RNA, 17 nt, Artificial Sequence
  CEP290-B78/-237 targeting domain (RNA)
gcuuuugacaguuuuua

SEQ ID NO: 635 - RNA, 20 nt, Artificial Sequence
  CEP290-B79/-238 targeting domain (RNA)
ggagauagagacaggaauaa

SEQ ID NO: 636 - RNA, 17 nt, Artificial Sequence
  CEP290-B233/-B1021/-248 targeting domain (RNA)
aaggcggggagucacau

SEQ ID NO: 637 - RNA, 17 nt, Artificial Sequence
  CEP290-B175/-B1023 targeting domain (RNA)
uaaggcggggagucaca

SEQ ID NO: 638 - RNA, 17 nt, Artificial Sequence
  CEP290-B280/-B1295 targeting domain (RNA)
ugaacucugugccaaac

SEQ ID NO: 639 - RNA, 17 nt, Artificial Sequence
  CEP290-B268 targeting domain (RNA)
uuuacccuucagguaac

SEQ ID NO: 640 - RNA, 17 nt, Artificial Sequence
  CEP290-B154 targeting domain (RNA)
ugacaccacaugcacug

SEQ ID NO: 641 - RNA, 17 nt, Artificial Sequence
  CEP290-B231 targeting domain (RNA)
uugcucuagaugacaug

SEQ ID NO: 642 - RNA, 17 nt, Artificial Sequence
  CEP290-B242/-B1296 targeting domain (RNA)
ugacaguuuuuaaggcg

SEQ ID NO: 643 - RNA, 17 nt, Artificial Sequence
  CEP290-B226/-B1302 targeting domain (RNA)
ugucaaauauggugcuu

SEQ ID NO: 644 - RNA, 17 nt, Artificial Sequence
  CEP290-B159/-175 targeting domain (RNA)
agucacaugggagucac

SEQ ID NO: 645 - RNA, 17 nt, Artificial Sequence
  CEP290-B222/-B1259/-190 targeting domain (RNA)
augagagugauuagugg

SEQ ID NO: 646 - RNA, 17 nt, Artificial Sequence
  CEP290-B274 targeting domain (RNA)
ugacaugagguaaguag

SEQ ID NO: 647 - RNA, 17 nt, Artificial Sequence
  CEP290-B68 targeting domain (RNA)
uacaugagagugauuag

SEQ ID NO: 648 - RNA, 17 nt, Artificial Sequence
  CEP290-B212/-B1282 targeting domain (RNA)
uaaggaggauguaagac

SEQ ID NO: 649 - RNA, 17 nt, Artificial Sequence
  CEP290-B270/-233 targeting domain (RNA)
cuugacuuuuacccuuc

SEQ ID NO: 650 - RNA, 17 nt, Artificial Sequence
  CEP290-B96/-B1290 targeting domain (RNA)
ucacugagcaaaacaac

SEQ ID NO: 651 - RNA, 17 nt, Artificial Sequence
  CEP290-B104/-B1227/-161 targeting domain (RNA)
agacuuauauuccauua

SEQ ID NO: 652 - RNA, 17 nt, Artificial Sequence
  CEP290-B122/-210 targeting domain (RNA)
caugggagucacagggu

SEQ ID NO: 653 - RNA, 17 nt, Artificial Sequence
  CEP290-B229 targeting domain (RNA)
uagaaugaucauucuug

SEQ ID NO: 654 - RNA, 17 nt, Artificial Sequence
  CEP290-B99/-B1314 targeting domain (RNA)
uugacaguuuuuaaggc

SEQ ID NO: 655 - RNA, 17 nt, Artificial Sequence
  CEP290-B7/-128 targeting domain (RNA)
aaacugucaaaagcuac

SEQ ID NO: 656 - RNA, 17 nt, Artificial Sequence
  CEP290-B37/-B1256/-188 targeting domain (RNA)
augacaugagguaagua

SEQ ID NO: 657 - RNA, 17 nt, Artificial Sequence
  CEP290-B97 targeting domain (RNA)
uguuucaaaacuuguuc

SEQ ID NO: 658 - RNA, 17 nt, Artificial Sequence
  CEP290-B173/-B1250/-182 targeting domain (RNA)
auaucugucuuccuuaa

SEQ ID NO: 659 - RNA, 17 nt, Artificial Sequence
  CEP290-B136/-B1294/-276 targeting domain (RNA)
ugaacaaguuuugaaac

SEQ ID NO: 660 - RNA, 17 nt, Artificial Sequence
  CEP290-B71 targeting domain (RNA)
uucugcaucuuauacau

SEQ ID NO: 661 - RNA, 17 nt, Artificial Sequence
  CEP290-B172/-B1244/-179 targeting domain (RNA)
auaagucuuuugauaua

SEQ ID NO: 662 - RNA, 17 nt, Artificial Sequence
  CEP290-B238/-B1318 targeting domain (RNA)
uuugacaguuuuuaagg

SEQ ID NO: 663 - RNA, 17 nt, Artificial Sequence
  CEP290-B148/-B1300 targeting domain (RNA)
ugcucuuuucuauauau

SEQ ID NO: 664 - RNA, 17 nt, Artificial Sequence
  CEP290-B208/-B1226/-255 targeting domain (RNA)
agacuggagauagagac

SEQ ID NO: 665 - RNA, 17 nt, Artificial Sequence
  CEP290-B53/-208 targeting domain (RNA)
cauaagaaagaacacug

SEQ ID NO: 666 - RNA, 17 nt, Artificial Sequence
  CEP290-B166/-280 targeting domain (RNA)
uucuuguggcaguaagg

SEQ ID NO: 667 - RNA, 17 nt, Artificial Sequence
  CEP290-B247/-B1215/-247 targeting domain (RNA)
aagcauacuuuuuuuaa

SEQ ID NO: 668 - RNA, 17 nt, Artificial Sequence
  CEP290-B245/-261 targeting domain (RNA)
caacuggaagagagaaa

SEQ ID NO: 669 - RNA, 17 nt, Artificial Sequence
  CEP290-B167/-272 targeting domain (RNA)
uaugcuuaagaaaaaaa

SEQ ID NO: 670 - RNA, 17 nt, Artificial Sequence
  CEP290-B171/-283 targeting domain (RNA)
uuuuauuaucuuuauug

SEQ ID NO: 671 - RNA, 20 nt, Artificial Sequence
  CEP290-B140/-B1151/-218/-1467 targeting domain (RNA)
cuagaugacaugagguaagu

SEQ ID NO: 672 - RNA, 20 nt, Artificial Sequence
  CEP290-B147/-B1019/-1886 targeting domain (RNA)
uuuuaaggcggggagucaca

SEQ ID NO: 673 - RNA, 20 nt, Artificial Sequence
  CEP290-B73 targeting domain (RNA)
uccuguuucaaaacuuguuc

SEQ ID NO: 674 - RNA, 20 nt, Artificial Sequence
  CEP290-B206 targeting domain (RNA)
uguguugaguaucuccuguu

SEQ ID NO: 675 - RNA, 20 nt, Artificial Sequence
  CEP290-B57/-223 targeting domain (RNA)
cucuugcucuagaugacaug

SEQ ID NO: 676 - RNA, 20 nt, Artificial Sequence
  CEP290-B82/-B1136/-206/-1475 targeting domain (RNA)
caguaaggaggauguaagac

SEQ ID NO: 677 - RNA, 20 nt, Artificial Sequence
  CEP290-B265/-163 targeting domain (RNA)
agaugacaugagguaaguag

SEQ ID NO: 678 - RNA, 20 nt, Artificial Sequence
  CEP290-B105/-B1098/-150/-1805 targeting domain (RNA)
aauucacugagcaaaacaac

SEQ ID NO: 679 - RNA, 20 nt, Artificial Sequence
  CEP290-B239 targeting domain (RNA)
ucacaugggagucacagggu

SEQ ID NO: 680 - RNA, 20 nt, Artificial Sequence
  CEP290-B180/-B1170/-1741 targeting domain (RNA)
uagaugacaugagguaagua

SEQ ID NO: 681 - RNA, 20 nt, Artificial Sequence
  CEP290-B103/-B1204/-669 targeting domain (RNA)
uuuugacaguuuuuaaggcg

SEQ ID NO: 682 - RNA, 20 nt, Artificial Sequence
  CEP290-B254 targeting domain (RNA)
uaauacaugagagugauuag

SEQ ID NO: 683 - RNA, 20 nt, Artificial Sequence
  CEP290-B134 targeting domain (RNA)
uaguucugcaucuuauacau

SEQ ID NO: 684 - RNA, 20 nt, Artificial Sequence
  CEP290-B240/-B1160/-235/-1838 targeting domain (RNA)
cuuuugacaguuuuuaaggc

SEQ ID NO: 685 - RNA, 20 nt, Artificial Sequence
  CEP290-B116/-B1087/-123/-1809 targeting domain (RNA)
aaaagacuuauauuccauua

SEQ ID NO: 686 - RNA, 20 nt, Artificial Sequence
  CEP290-B39/-180 targeting domain (RNA)
auacauaagaaagaacacug

SEQ ID NO: 687 - RNA, 20 nt, Artificial Sequence
  CEP290-B91/-B1096/-145/-1685 targeting domain (RNA)
aauauaagucuuuugauaua

SEQ ID NO: 688 - RNA, 20 nt, Artificial Sequence
  CEP290-B126/-B1188/-1910 targeting domain (RNA)
ugaucauucuuguggcagua

SEQ ID NO: 689 - RNA, 20 nt, Artificial Sequence
  CEP290-B202/-B1164/-691 targeting domain (RNA)
uacauaucugucuuccuuaa

SEQ ID NO: 690 - RNA, 20 nt, Artificial Sequence
  CEP290-B152/-B1157/-228/-1716 targeting domain (RNA)
cuuaagcauacuuuuuuuaa

SEQ ID NO: 691 - RNA, 20 nt, Artificial Sequence
  CEP290-B77/-126 targeting domain (RNA)
aaacaacuggaagagagaaa

SEQ ID NO: 692 - RNA, 20 nt, Artificial Sequence
  CEP290-B145/-273 targeting domain (RNA)
ucauucuuguggcaguaagg

SEQ ID NO: 693 - RNA, 20 nt, Artificial Sequence
  CEP290-B72/-249 targeting domain (RNA)
aaguaugcuuaagaaaaaaa

SEQ ID NO: 694 - RNA, 20 nt, Artificial Sequence
  CEP290-B221/-260 targeting domain (RNA)
auuuuuuauuaucuuuauug

SEQ ID NO: 695 - RNA, 17 nt, Artificial Sequence
  CEP290-B424/-B1269/-219 targeting domain (RNA)
cuaggacuuucuaaugc

SEQ ID NO: 696 - RNA, 17 nt, Artificial Sequence
  CEP290-B425/-B1254/-186 targeting domain (RNA)
aucuaagauccuuucac

SEQ ID NO: 697 - RNA, 17 nt, Artificial Sequence
  CEP290-B426 targeting domain (RNA)
uuaucaccacacuaaau

SEQ ID NO: 698 - RNA, 17 nt, Artificial Sequence
  CEP290-B427/-B495/-167 targeting domain (RNA)
agcucaaaagcuuuugc

SEQ ID NO: 699 - RNA, 17 nt, Artificial Sequence
  CEP290-B428/-B529 targeting domain (RNA)
uguucugaguagcuuuc

SEQ ID NO: 700 - RNA, 17 nt, Artificial Sequence
  CEP290-B429/-157 targeting domain (RNA)
acuuucuaaugcuggag

SEQ ID NO: 701 - RNA, 17 nt, Artificial Sequence
  CEP290-B430/-222 targeting domain (RNA)
cucuauaccuuuuacug

SEQ ID NO: 702 - RNA, 17 nt, Artificial Sequence
  CEP290-B431/-200 targeting domain (RNA)
caagaugucucuugccu

SEQ ID NO: 703 - RNA, 17 nt, Artificial Sequence
  CEP290-B432/-194 targeting domain (RNA)
auuaugccuauuuagug

SEQ ID NO: 704 - RNA, 17 nt, Artificial Sequence
  CEP290-B433/-B513/-B1257/-B1258/-189 targeting domain (RNA)
augacucauaauuuagu

SEQ ID NO: 705 - RNA, 17 nt, Artificial Sequence
  CEP290-B434 targeting domain (RNA)
uagaggcuuauggauuu

SEQ ID NO: 706 - RNA, 17 nt, Artificial Sequence
  CEP290-B435/-B490 targeting domain (RNA)
uauucuacuccugugaa

SEQ ID NO: 707 - RNA, 17 nt, Artificial Sequence
  CEP290-B437/-217 targeting domain (RNA)
cuaaugcuggagaggau

SEQ ID NO: 708 - RNA, 17 nt, Artificial Sequence
  CEP290-B438/-172 targeting domain (RNA)
aggcaagagacaucuug

SEQ ID NO: 709 - RNA, 17 nt, Artificial Sequence
  CEP290-B439/-B1234/-165 targeting domain (RNA)
agccucuauuucugaug

SEQ ID NO: 710 - RNA, 17 nt, Artificial Sequence
  CEP290-B440/-204 targeting domain (RNA)
cagcauuagaaaguccu

SEQ ID NO: 711 - RNA, 17 nt, Artificial Sequence
  CEP290-B441/-B485/-B299/-B531/-225/-1952 targeting domain (RNA)
cugcuuuugccaaagag

SEQ ID NO: 712 - RNA, 17 nt, Artificial Sequence
  CEP290-B442/-B492/-154 targeting domain (RNA)
acauaaucaccucucuu

SEQ ID NO: 713 - RNA, 17 nt, Artificial Sequence
  CEP290-B443 targeting domain (RNA)
ucagaaauagaggcuua

SEQ ID NO: 714 - RNA, 17 nt, Artificial Sequence
  CEP290-B446 targeting domain (RNA)
uuccucaucagaaauag

SEQ ID NO: 715 - RNA, 17 nt, Artificial Sequence
  CEP290-B447/-B1220/-250 targeting domain (RNA)
acagaggacauggagaa

SEQ ID NO: 716 - RNA, 17 nt, Artificial Sequence
  CEP290-B448 targeting domain (RNA)
uggagaggauaggacag

SEQ ID NO: 717 - RNA, 17 nt, Artificial Sequence
  CEP290-B449/-B1235/-169 targeting domain (RNA)
aggaagaugaacaaauc

SEQ ID NO: 718 - RNA, 17 nt, Artificial Sequence
  CEP290-B450/-B1231/-257 targeting domain (RNA)
agaugaaaaauacucuu

SEQ ID NO: 719 - RNA, 20 nt, Artificial Sequence
  CEP290-B455/-171 targeting domain (RNA)
aggacuuucuaaugcuggag

SEQ ID NO: 720 - RNA, 20 nt, Artificial Sequence
  CEP290-B457/-221 targeting domain (RNA)
cuccagcauuagaaaguccu

SEQ ID NO: 721 - RNA, 20 nt, Artificial Sequence
  CEP290-B458/-B506/-B1094/-B1095/-137/-388 targeting domain (RNA)
aacaugacucauaauuuagu

SEQ ID NO: 722 - RNA, 20 nt, Artificial Sequence
  CEP290-B460/-187 targeting domain (RNA)
aucuuccucaucagaaauag

SEQ ID NO: 723 - RNA, 20 nt, Artificial Sequence
  CEP290-B461/-B1114/-178/-1206 targeting domain (RNA)
auaagccucuauuucugaug

SEQ ID NO: 724 - RNA, 20 nt, Artificial Sequence
  CEP290-B462/-B500 targeting domain (RNA)
ucuuauucuacuccugugaa

SEQ ID NO: 725 - RNA, 20 nt, Artificial Sequence
  CEP290-B463/-B521/-B304/-B478/-224/-1951 targeting domain (RNA
cugcugcuuuugccaaagag

SEQ ID NO: 726 - RNA, 20 nt, Artificial Sequence
  CEP290-B464 targeting domain (RNA)
uuucuaaugcuggagaggau

SEQ ID NO: 727 - RNA, 20 nt, Artificial Sequence
  CEP290-134/-B466 targeting domain (RNA)
aaauuaucaccacacuaaau

SEQ ID NO: 728 - RNA, 20 nt, Artificial Sequence
  CEP290-B467/-234 targeting domain (RNA)
cuuguucuguccucaguaaa

SEQ ID NO: 729 - RNA, 20 nt, Artificial Sequence
  CEP290-B468/-125 targeting domain (RNA)
aaaauuaugccuauuuagug

SEQ ID NO: 730 - RNA, 20 nt, Artificial Sequence
  CEP290-B469 targeting domain (RNA)
ucaucagaaauagaggcuua

SEQ ID NO: 731 - RNA, 20 nt, Artificial Sequence
  CEP290-B133/-B470 targeting domain (RNA)
aaauagaggcuuauggauuu

SEQ ID NO: 732 - RNA, 20 nt, Artificial Sequence
  CEP290-B471 targeting domain (RNA)
ugcuggagaggauaggacag

SEQ ID NO: 733 - RNA, 20 nt, Artificial Sequence
  CEP290-B472/-B1120/-191/-1083 targeting domain (RNA)
augaggaagaugaacaaauc

SEQ ID NO: 734 - RNA, 20 nt, Artificial Sequence
  CEP290-B474/-B1158/-232/-459 targeting domain (RNA)
cuuaucuaagauccuuucac

SEQ ID NO: 735 - RNA, 20 nt, Artificial Sequence
  CEP290-B475/-B1104/-162/-840 targeting domain (RNA)
agaggauaggacagaggaca

SEQ ID NO: 736 - RNA, 20 nt, Artificial Sequence
  CEP290-B476/-B1110/-170/-852 targeting domain (RNA)
aggacagaggacauggagaa

SEQ ID NO: 737 - RNA, 20 nt, Artificial Sequence
  CEP290-B477/-B1090/-130/-846 targeting domain (RNA)
aaagaugaaaaauacucuuu

SEQ ID NO: 738-746 - skipped (9 entries)

SEQ ID NO: 747 - RNA, 20 nt, Artificial Sequence
  CEP290-B1009/-1700 targeting domain (RNA)
ccuacuuaccucaugucauc

SEQ ID NO: 748 - RNA, 20 nt, Artificial Sequence
  CEP290-B1010/-B1152/-1093 targeting domain (RNA)
cuaugagccagcaaaagcuu

SEQ ID NO: 749 - RNA, 20 nt, Artificial Sequence
  CEP290-B1011/-B1102/-352 targeting domain (RNA)
acguuguucugaguagcuuu

SEQ ID NO: 750 - RNA, 20 nt, Artificial Sequence
  CEP290-B1012/-B1138/-875 targeting domain (RNA)
cauagagacacauucaguaa

SEQ ID NO: 751 - RNA, 17 nt, Artificial Sequence
  CEP290-B1013 targeting domain (RNA)
acuuaccucaugucauc

SEQ ID NO: 752 - RNA, 17 nt, Artificial Sequence
  CEP290-B1014/-B1297 targeting domain (RNA)
ugagccagcaaaagcuu

SEQ ID NO: 753 - RNA, 17 nt, Artificial Sequence
  CEP290-B1015/-B1317 targeting domain (RNA)
uuguucugaguagcuuu

SEQ ID NO: 754 - RNA, 17 nt, Artificial Sequence
  CEP290-B1016/-B1228 targeting domain (RNA)
agagacacauucaguaa

SEQ ID NO: 755 - RNA, 20 nt, Artificial Sequence
  CEP290-B1018/-626 targeting domain (RNA)
caaaagcuaccgguuaccug

SEQ ID NO: 756 - skipped

SEQ ID NO: 757 - RNA, 20 nt, Artificial Sequence
  CEP290-B1020/-1889 targeting domain (RNA)
ugucaaaagcuaccgguuac

SEQ ID NO: 758 - RNA, 17 nt, Artificial Sequence
  CEP290-B1022 targeting domain (RNA)
aagcuaccgguuaccug

SEQ ID NO: 759 - RNA, 17 nt, Artificial Sequence
  CEP290-B1024 targeting domain (RNA)
caaaagcuaccgguuac

SEQ ID NO: 760 - RNA, 20 nt, Artificial Sequence
  CEP290-B1025/-B1171/-1166 targeting domain (RNA)
uaggaauccugaaagcuacu

SEQ ID NO: 761 - RNA, 20 nt, Artificial Sequence
  CEP290-B1026/-B1132/-452 targeting domain (RNA)
cagaacaacguuuucauuua

SEQ ID NO: 762 - RNA, 20 nt, Artificial Sequence
  CEP290-B1027/-B1126/-877 targeting domain (RNA)
caaaagcuuuugcuggcuca

SEQ ID NO: 763 - RNA, 20 nt, Artificial Sequence
  CEP290-B1028/-B1106/-363 targeting domain (RNA)
agcaaaagcuuuugagcuaa

SEQ ID NO: 764 - RNA, 20 nt, Artificial Sequence
  CEP290-B1118/-365 targeting domain (RNA)
aucuuauucuacuccuguga

SEQ ID NO: 765 - RNA, 17 nt, Artificial Sequence
  CEP290-B1030/-B1209 targeting domain (RNA)
aacaacguuuucauuua

SEQ ID NO: 766 - RNA, 17 nt, Artificial Sequence
  CEP290-B1031/-B1217 targeting domain (RNA)
aagcuuuugcuggcuca

SEQ ID NO: 767 - RNA, 17 nt, Artificial Sequence
  CEP290-B1032/-B1206 targeting domain (RNA)
aaaagcuuuugagcuaa

SEQ ID NO: 768 - RNA, 17 nt, Artificial Sequence
  CEP290-B1033/-B1309 targeting domain (RNA)
uuauucuacuccuguga

SEQ ID NO: 769 - RNA, 20 nt, Artificial Sequence
  CEP290-B1034/-1730 targeting domain (RNA)
gaaacaggaauagaaauuca

SEQ ID NO: 770 - RNA, 20 nt, Artificial Sequence
  CEP290-B1037/-1551 targeting domain (RNA)
gaauauaagucuuuugauau

SEQ ID NO: 771 - RNA, 20 nt, Artificial Sequence
  CEP290-B1038/-1534 targeting domain (RNA)
gagaaaugguucccuauaua

SEQ ID NO: 772 - RNA, 20 nt, Artificial Sequence
  CEP290-B1039/-1295 targeting domain (RNA)
gagaggauaggacagaggac

SEQ ID NO: 773 - RNA, 20 nt, Artificial Sequence
  CEP290-B1040/-1292 targeting domain (RNA)
gaugaggaagaugaacaaau

SEQ ID NO: 774 - RNA, 20 nt, Artificial Sequence
  CEP290-B1042/-937 targeting domain (RNA)
gauuuguucaucuuccucau

SEQ ID NO: 775 - RNA, 20 nt, Artificial Sequence
  CEP290-B1043/-1875 targeting domain (RNA)
gcaguaaggaggauguaaga

SEQ ID NO: 776 - RNA, 20 nt, Artificial Sequence
  CEP290-B1046/-B1047/-950 targeting domain (RNA)
gcuuucugcugcuuuugcca

SEQ ID NO: 777 - skipped

SEQ ID NO: 778 - RNA, 20 nt, Artificial Sequence
  CEP290-B1049/-959 targeting domain (RNA)
ggaaagaugaaaaauacucu

SEQ ID NO: 779 - RNA, 20 nt, Artificial Sequence
  CEP290-B1050/-1544 targeting domain (RNA)
ggaggauguaagacuggaga

SEQ ID NO: 780 - RNA, 20 nt, Artificial Sequence
  CEP290-B1052/-B1053/-940 targeting domain (RNA)
ggugauuauguuacuuuuua

SEQ ID NO: 781 - skipped

SEQ ID NO: 782 - RNA, 20 nt, Artificial Sequence
  CEP290-B1056/-1506 targeting domain (RNA)
guggugucaaauauggugcu

SEQ ID NO: 783 - RNA, 17 nt, Artificial Sequence
  CEP290-B1057 targeting domain (RNA)
gaaaaaaaagguaaugc

SEQ ID NO: 784 - RNA, 17 nt, Artificial Sequence
  CEP290-B1058 targeting domain (RNA)
gaaaagagcacguacaa

SEQ ID NO: 785 - RNA, 17 nt, Artificial Sequence
  CEP290-B1060 targeting domain (RNA)
gaaugaucauucuaaac

SEQ ID NO: 786 - RNA, 17 nt, Artificial Sequence
  CEP290-B1061 targeting domain (RNA)
gacagaggacauggaga

SEQ ID NO: 787 - RNA, 17 nt, Artificial Sequence
  CEP290-B1062 targeting domain (RNA)
gacuuucuaaugcugga

SEQ ID NO: 788 - RNA, 17 nt, Artificial Sequence
  CEP290-B1063 targeting domain (RNA)
gagagugauuaguggug

SEQ ID NO: 789 - RNA, 17 nt, Artificial Sequence
  CEP290-B1064 targeting domain (RNA)
gagcaaaacaacuggaa

SEQ ID NO: 790 - RNA, 17 nt, Artificial Sequence
  CEP290-B1065 targeting domain (RNA)
gaggaagaugaacaaau

SEQ ID NO: 791 - RNA, 17 nt, Artificial Sequence
  CEP290-B1066 targeting domain (RNA)
gagucacaugggaguca

SEQ ID NO: 792 - RNA, 17 nt, Artificial Sequence
  CEP290-B1067/-B1068 targeting domain (RNA)
gaucuuauucuacuccu

SEQ ID NO: 793 - RNA, 17 nt, Artificial Sequence
  CEP290-B1071/-B1072 targeting domain (RNA)
gauuauguuacuuuuua

SEQ ID NO: 794 - RNA, 17 nt, Artificial Sequence
  CEP290-B1073 targeting domain (RNA)
gcaaaacaacuggaaga

SEQ ID NO: 795 - RNA, 17 nt, Artificial Sequence
  CEP290-B1077 targeting domain (RNA)
ggauguaagacuggaga

SEQ ID NO: 796 - RNA, 17 nt, Artificial Sequence
  CEP290-B1078 targeting domain (RNA)
guaaggaggauguaaga

SEQ ID NO: 797 - RNA, 17 nt, Artificial Sequence
  CEP290-B1079 targeting domain (RNA)
guaucuccuguuuggca

SEQ ID NO: 798 - RNA, 17 nt, Artificial Sequence
  CEP290-B1080 targeting domain (RNA)
gucaucuagagcaagag

SEQ ID NO: 799 - RNA, 17 nt, Artificial Sequence
  CEP290-B1081 targeting domain (RNA)
guccucaguaaaaggua

SEQ ID NO: 800 - RNA, 17 nt, Artificial Sequence
  CEP290-B1082 targeting domain (RNA)
gugaaaggaucuuagau

SEQ ID NO: 801 - RNA, 17 nt, Artificial Sequence
  CEP290-B1083 targeting domain (RNA)
gugcucuuuucuauaua

SEQ ID NO: 802 - RNA, 17 nt, Artificial Sequence
  CEP290-B1084 targeting domain (RNA)
gugucaaauauggugcu

SEQ ID NO: 803 - RNA, 17 nt, Artificial Sequence
  CEP290-B1085 targeting domain (RNA)
guucccuauauauagaa

SEQ ID NO: 804 - skipped

SEQ ID NO: 805 - RNA, 20 nt, Artificial Sequence
  CEP290-B1088/-B1089/-829 targeting domain (RNA)
aaacaugacucauaauuuag

SEQ ID NO: 806-807 - skipped (2 entries)

SEQ ID NO: 808 - RNA, 20 nt, Artificial Sequence
  CEP290-B1091/-1440 targeting domain (RNA)
aaauucacugagcaaaacaa

SEQ ID NO: 809 - RNA, 20 nt, Artificial Sequence
  CEP290-B1092/-1383 targeting domain (RNA)
aacaaguuuugaaacaggaa

SEQ ID NO: 810 - RNA, 20 nt, Artificial Sequence
  CEP290-B1093/-1372 targeting domain (RNA)
aacaggagauacucaacaca

SEQ ID NO: 811-813 - skipped (3 entries)

SEQ ID NO: 814 - RNA, 20 nt, Artificial Sequence
  CEP290-B1097/-1663 targeting domain (RNA)
aaucacucucauguauuagc

SEQ ID NO: 815 - skipped

SEQ ID NO: 816 - RNA, 20 nt, Artificial Sequence
  CEP290-B1099/-1688 targeting domain (RNA)
acaaaagaacauacauaaga

SEQ ID NO: 817 - RNA, 20 nt, Artificial Sequence
  CEP290-B1100/-1375 targeting domain (RNA)
acguacaaaagaacauacau

SEQ ID NO: 818 - skipped

SEQ ID NO: 819 - RNA, 20 nt, Artificial Sequence
  CEP290-B1103/-1388 targeting domain (RNA)
acugagcaaaacaacuggaa

SEQ ID NO: 820 - skipped

SEQ ID NO: 821 - RNA, 20 nt, Artificial Sequence
  CEP290-B1105/-1787 targeting domain (RNA)
agaugcagaacuaguguaga

SEQ ID NO: 822 - skipped

SEQ ID NO: 823 - RNA, 20 nt, Artificial Sequence
  CEP290-B1107/-790 targeting domain (RNA)
agcauuagaaaguccuaggc

SEQ ID NO: 824 - RNA, 20 nt, Artificial Sequence
  CEP290-B1108/-1782 targeting domain (RNA)
agcuugaacucugugccaaa

SEQ ID NO: 825 - RNA, 20 nt, Artificial Sequence
  CEP290-B1109/-1801 targeting domain (RNA)
agcuuuugacaguuuuuaag

SEQ ID NO: 826 - skipped

SEQ ID NO: 827 - RNA, 20 nt, Artificial Sequence
  CEP290-B1111/-410 targeting domain (RNA)
aggauaggacagaggacaug

SEQ ID NO: 828 - RNA, 20 nt, Artificial Sequence
  CEP290-B1112/-1393 targeting domain (RNA)
agguaaugccugaacaaguu

SEQ ID NO: 829 - RNA, 20 nt, Artificial Sequence
  CEP290-B1113/-1406 targeting domain (RNA)
auaagaaagaacacuguggu

SEQ ID NO: 830 - skipped

SEQ ID NO: 831 - RNA, 20 nt, Artificial Sequence
  CEP290-B1115/-1779 targeting domain (RNA)
auacaugagagugauuagug

SEQ ID NO: 832 - RNA, 20 nt, Artificial Sequence
  CEP290-B1116/-1678 targeting domain (RNA)
auagaaaagagcacguacaa

SEQ ID NO: 833 - RNA, 20 nt, Artificial Sequence
  CEP290-B1117/-601 targeting domain (RNA)
aucauucuuguggcaguaag

SEQ ID NO: 834 - skipped

SEQ ID NO: 835 - RNA, 20 nt, Artificial Sequence
  CEP290-B1119/-358 targeting domain (RNA)
aucuuguggauaauguauca

SEQ ID NO: 836 - skipped

SEQ ID NO: 837 - RNA, 20 nt, Artificial Sequence
  CEP290-B1121/-1798 targeting domain (RNA)
augaucauucuuguggcagu

SEQ ID NO: 838 - RNA, 20 nt, Artificial Sequence
  CEP290-B1122/-1075 targeting domain (RNA)
augcuggagaggauaggaca

SEQ ID NO: 839 - RNA, 20 nt, Artificial Sequence
  CEP290-B1123/-1683 targeting domain (RNA)
augguucccuauauauagaa

SEQ ID NO: 840 - RNA, 20 nt, Artificial Sequence
  CEP290-B1124/-624 targeting domain (RNA)
auuuaauuuguuucugugug

SEQ ID NO: 841 - RNA, 20 nt, Artificial Sequence
  CEP290-B1125/-1712 targeting domain (RNA)
caaaaccuauguauaagaug

SEQ ID NO: 842 - RNA, 20 nt, Artificial Sequence
  CEP290-B1126/-1495 targeting domain (RNA)
caaaagacuuauauuccauu

SEQ ID NO: 843 - skipped

SEQ ID NO: 844 - RNA, 20 nt, Artificial Sequence
  CEP290-B1128/-637 targeting domain (RNA)
caagaaugaucauucuaaac

SEQ ID NO: 845 - RNA, 20 nt, Artificial Sequence
  CEP290-B1129/-1461 targeting domain (RNA)
cacagaguucaagcuaauac

SEQ ID NO: 846 - RNA, 20 nt, Artificial Sequence
  CEP290-B1130/-629 targeting domain (RNA)
cacaggguaggauucauguu

SEQ ID NO: 847 - skipped

SEQ ID NO: 848 - RNA, 20 nt, Artificial Sequence
  CEP290-B1133/-632 targeting domain (RNA)
cagaguucaagcuaauacau

SEQ ID NO: 849 - RNA, 20 nt, Artificial Sequence
  CEP290-B1134/-B1135/-457 targeting domain (RNA)
caguaaaugaaaacguuguu

SEQ ID NO: 850 - skipped

SEQ ID NO: 851 - RNA, 20 nt, Artificial Sequence
  CEP290-B1137/-879 targeting domain (RNA)
cauaagccucuauuucugau

SEQ ID NO: 852 - skipped

SEQ ID NO: 853 - RNA, 20 nt, Artificial Sequence
  CEP290-B1139/-1829 targeting domain (RNA)
caucucuugcucuagaugac

SEQ ID NO: 854 - RNA, 20 nt, Artificial Sequence
  CEP290-B1140/-1710 targeting domain (RNA)
caugagagugauuaguggug

SEQ ID NO: 855 - RNA, 20 nt, Artificial Sequence
  CEP290-B1141/-1709 targeting domain (RNA)
caugucaucuagagcaagag

SEQ ID NO: 856 - RNA, 20 nt, Artificial Sequence
  CEP290-B1142/-B1143/-1117 targeting domain (RNA)
cauuuacugaaugugucucu

SEQ ID NO: 857 - RNA, 20 nt, Artificial Sequence
  CEP290-B1144/-1493 targeting domain (RNA)
ccauuaaaaaaaguaugcuu

SEQ ID NO: 858 - RNA, 20 nt, Artificial Sequence
  CEP290-B1145/-1232 targeting domain (RNA)
ccuaggacuuucuaaugcug

SEQ ID NO: 859 - RNA, 20 nt, Artificial Sequence
  CEP290-B1146/-B1147/-888 targeting domain (RNA)
ccucucuuuggcaaaagcag

SEQ ID NO: 860 - RNA, 20 nt, Artificial Sequence
  CEP290-B1148/-424 targeting domain (RNA)
ccugugaaaggaucuuagau

SEQ ID NO: 861 - RNA, 20 nt, Artificial Sequence
  CEP290-B1150/-443 targeting domain (RNA)
cuaagauccuuucacaggag

SEQ ID NO: 862-863 - skipped (2 entries)

SEQ ID NO: 864 - RNA, 20 nt, Artificial Sequence
  CEP290-B1153/-B1154/-885 targeting domain (RNA)
cucauaauuuaguaggaauc

SEQ ID NO: 865 - RNA, 20 nt, Artificial Sequence
  CEP290-B1155/-446 targeting domain (RNA)
cucaucagaaauagaggcuu

SEQ ID NO: 866 - RNA, 20 nt, Artificial Sequence
  CEP290-B1156/-1114 targeting domain (RNA)
cucuauuucugaugaggaag

SEQ ID NO: 867-868 - skipped (2 entries)

SEQ ID NO: 869 - RNA, 20 nt, Artificial Sequence
  CEP290-B1159/-1108 targeting domain (RNA)
cuuucuaaugcuggagagga

SEQ ID NO: 870 - skipped

SEQ ID NO: 871 - RNA, 20 nt, Artificial Sequence
  CEP290-B1161/-52/-1645 targeting domain (RNA)
uaaaacuaagacacugccaa

SEQ ID NO: 872 - RNA, 20 nt, Artificial Sequence
  CEP290-B1162/-1760 targeting domain (RNA)
uaagaaaaaaaagguaaugc

SEQ ID NO: 873 - RNA, 20 nt, Artificial Sequence
  CEP290-B1163/-1318 targeting domain (RNA)
uaaugcuggagaggauagga

SEQ ID NO: 874 - skipped

SEQ ID NO: 875 - RNA, 20 nt, Artificial Sequence
  CEP290-B1165/-661 targeting domain (RNA)
uacauccuccuuacugccac

SEQ ID NO: 876 - RNA, 20 nt, Artificial Sequence
  CEP290-B1167/-1567 targeting domain (RNA)
uaccucaugucaucuagagc

SEQ ID NO: 877 - RNA, 20 nt, Artificial Sequence
  CEP290-B1168/-1604 targeting domain (RNA)
uacgugcucuuuucuauaua

SEQ ID NO: 878 - RNA, 20 nt, Artificial Sequence
  CEP290-B1169/-675 targeting domain (RNA)
uagagcaagagaugaacuag

SEQ ID NO: 879-880 - skipped (2 entries)

SEQ ID NO: 881 - RNA, 20 nt, Artificial Sequence
  CEP290-B1172/-1040 targeting domain (RNA)
uaggacagaggacauggaga

SEQ ID NO: 882 - RNA, 20 nt, Artificial Sequence
  CEP290-B1173/-473 targeting domain (RNA)
uaggacuuucuaaugcugga

SEQ ID NO: 883 - RNA, 20 nt, Artificial Sequence
  CEP290-B1174/-1594 targeting domain (RNA)
ucacugagcaaaacaacugg

SEQ ID NO: 884 - RNA, 20 nt, Artificial Sequence
  CEP290-B1175/-B1176/-1333 targeting domain (RNA)
ucauguuuaucaauauuauu

SEQ ID NO: 885 - RNA, 20 nt, Artificial Sequence
  CEP290-B1177/-1149 targeting domain (RNA)
uccacaagaugucucuugcc

SEQ ID NO: 886 - RNA, 20 nt, Artificial Sequence
  CEP290-B1178/-1319 targeting domain (RNA)
uccauaagccucuauuucug

SEQ ID NO: 887 - RNA, 20 nt, Artificial Sequence
  CEP290-B1179/-523 targeting domain (RNA)
uccuaggcaagagacaucuu

SEQ ID NO: 888 - RNA, 20 nt, Artificial Sequence
  CEP290-B1180/-1902 targeting domain (RNA)
ucuagaugacaugagguaag

SEQ ID NO: 889 - RNA, 20 nt, Artificial Sequence
  CEP290-B1181/-1160 targeting domain (RNA)
ucuauaccuuuuacugagga

SEQ ID NO: 890 - RNA, 20 nt, Artificial Sequence
  CEP290-B1182/-540 targeting domain (RNA)
ucuguccucaguaaaaggua

SEQ ID NO: 891 - RNA, 20 nt, Artificial Sequence
  CEP290-B1183/-1650 targeting domain (RNA)
ucuuaagcauacuuuuuuua

SEQ ID NO: 892 - RNA, 20 nt, Artificial Sequence
  CEP290-B1184/-1341 targeting domain (RNA)
ucuuaucuaagauccuuuca

SEQ ID NO: 893 - RNA, 20 nt, Artificial Sequence
  CEP290-B1185/-685 targeting domain (RNA)
ucuuccaguuguuuugcuca

SEQ ID NO: 894 - RNA, 20 nt, Artificial Sequence
  CEP290-B1186/-1618 targeting domain (RNA)
ugagcaaaacaacuggaaga

SEQ ID NO: 895 - RNA, 20 nt, Artificial Sequence
  CEP290-B1187/-667 targeting domain (RNA)
ugaguaucuccuguuuggca

SEQ ID NO: 896 - skipped

SEQ ID NO: 897 - RNA, 20 nt, Artificial Sequence
  CEP290-B1190/-1597 targeting domain (RNA)
ugccugaacaaguuuugaaa

SEQ ID NO: 898 - RNA, 20 nt, Artificial Sequence
  CEP290-B1192/-1640 targeting domain (RNA)
uguaagacuggagauagaga

SEQ ID NO: 899 - RNA, 20 nt, Artificial Sequence
  CEP290-B1193/-1014 targeting domain (RNA)
uguccuauccucuccagcau

SEQ ID NO: 900 - RNA, 20 nt, Artificial Sequence
  CEP290-B1194/-550 targeting domain (RNA)
uuaacguuaucauuuuccca

SEQ ID NO: 901 - RNA, 20 nt, Artificial Sequence
  CEP290-B1195/-1627 targeting domain (RNA)
uuacauaucugucuuccuua

SEQ ID NO: 902 - RNA, 20 nt, Artificial Sequence
  CEP290-B1196/-B1197/-1002 targeting domain (RNA)
uuagaucuuauucuacuccu

SEQ ID NO: 903 - skipped

SEQ ID NO: 904 - RNA, 20 nt, Artificial Sequence
  CEP290-B1198/-B1199/-535 targeting domain (RNA)
uucaggauuccuacuaaauu

SEQ ID NO: 905 - RNA, 20 nt, Artificial Sequence
  CEP290B1200/-1351 targeting domain (RNA)
uucaucuuccucaucagaaa

SEQ ID NO: 906 - RNA, 20 nt, Artificial Sequence
  CEP290-B1201/-1310 targeting domain (RNA)
uugccuaggacuuucuaaug

SEQ ID NO: 907 - RNA, 20 nt, Artificial Sequence
  CEP290-B1202/-B1203/-1322 targeting domain (RNA)
uuucugcugcuuuugccaaa

SEQ ID NO: 908 - skipped

SEQ ID NO: 909 - RNA, 20 nt, Artificial Sequence
  CEP290-B1205/-1568 targeting domain (RNA)
uuuuuaaggcggggagucac

SEQ ID NO: 910 - skipped

SEQ ID NO: 911 - RNA, 17 nt, Artificial Sequence
  CEP290-B1207 targeting domain (RNA)
aaagaacauacauaaga

SEQ ID NO: 912 - RNA, 17 nt, Artificial Sequence
  CEP290-B1208 targeting domain (RNA)
aaaugguucccuauaua

SEQ ID NO: 913 - skipped

SEQ ID NO: 914 - RNA, 17 nt, Artificial Sequence
  CEP290-B1210 targeting domain (RNA)
aaccuauguauaagaug

SEQ ID NO: 915 - RNA, 17 nt, Artificial Sequence
  CEP290-B1211 targeting domain (RNA)
aacuaagacacugccaa

SEQ ID NO: 916 - RNA, 17 nt, Artificial Sequence
  CEP290-B1212 targeting domain (RNA)
aagacuggagauagaga

SEQ ID NO: 917 - RNA, 17 nt, Artificial Sequence
  CEP290-B1213 targeting domain (RNA)
aagacuuauauuccauu

SEQ ID NO: 918 - RNA, 17 nt, Artificial Sequence
  CEP290-B1214 targeting domain (RNA)
aagaugaaaaauacucu

SEQ ID NO: 919 - skipped

SEQ ID NO: 920 - RNA, 17 nt, Artificial Sequence
  CEP290-B1216 targeting domain (RNA)
aagccucuauuucugau

SEQ ID NO: 921 - skipped

SEQ ID NO: 922 - RNA, 17 nt, Artificial Sequence
  CEP290-1218 targeting domain (RNA)
aaguuuugaaacaggaa

SEQ ID NO: 923 - RNA, 17 nt, Artificial Sequence
  CEP290-B1219 targeting domain (RNA)
acaagaugucucuugcc

SEQ ID NO: 924 - skipped

SEQ ID NO: 925 - RNA, 17 nt, Artificial Sequence
  CEP290-B1221 targeting domain (RNA)
acaggaauagaaauuca

SEQ ID NO: 926 - RNA, 17 nt, Artificial Sequence
  CEP290-B1222 targeting domain (RNA)
acaugggagucacaggg

SEQ ID NO: 927 - RNA, 17 nt, Artificial Sequence
  CEP290-B1223 targeting domain (RNA)
acguuaucauuuuccca

SEQ ID NO: 928 - RNA, 17 nt, Artificial Sequence
  CEP290-B1225 targeting domain (RNA)
agaaagaacacuguggu

SEQ ID NO: 929-930 - skipped (2 entries)

SEQ ID NO: 931 - RNA, 17 nt, Artificial Sequence
  CEP290-B1229 targeting domain (RNA)
agaguucaagcuaauac

SEQ ID NO: 932 - RNA, 17 nt, Artificial Sequence
  CEP290-B1230 targeting domain (RNA)
agauccuuucacaggag

SEQ ID NO: 933 - skipped

SEQ ID NO: 934 - RNA, 17 nt, Artificial Sequence
  CEP290-B1232 targeting domain (RNA)
agaugacaugagguaag

SEQ ID NO: 935 - RNA, 17 nt, Artificial Sequence
  CE290-B1233 targeting domain (RNA)
agcaagagaugaacuag

SEQ ID NO: 936-937 - skipped (2 entries)

SEQ ID NO: 938 - RNA, 17 nt, Artificial Sequence
  CEP290-B1236 targeting domain (RNA)
aggacuuucuaaugcug

SEQ ID NO: 939 - RNA, 17 nt, Artificial Sequence
  CEP290-B1237 targeting domain (RNA)
aggagauacucaacaca

SEQ ID NO: 940 - RNA, 17 nt, Artificial Sequence
  CEP290-B1238 targeting domain (RNA)
aggauaggacagaggac

SEQ ID NO: 941 - RNA, 17 nt, Artificial Sequence
  CEP290-B1239/-B1240 targeting domain (RNA)
aggauuccuacuaaauu

SEQ ID NO: 942 - RNA, 17 nt, Artificial Sequence
  CEP290-B1241 targeting domain (RNA)
aggguaggauucauguu

SEQ ID NO: 943 - RNA, 17 nt, Artificial Sequence
  CEP290-B1242 targeting domain (RNA)
aguucaagcuaauacau

SEQ ID NO: 944 - RNA, 17 nt, Artificial Sequence
  CEP290-B1243 targeting domain (RNA)
auaagccucuauuucug

SEQ ID NO: 945 - skipped

SEQ ID NO: 946 - RNA, 17 nt, Artificial Sequence
  CEP290-B1245/-B1246 targeting domain (RNA)
auaauuuaguaggaauc

SEQ ID NO: 947 - RNA, 17 nt, Artificial Sequence
  CEP290-B1247 targeting domain (RNA)
auaccuuuuacugagga

SEQ ID NO: 948 - RNA, 17 nt, Artificial Sequence
  CEP290-B1248 targeting domain (RNA)
auagaggcuuauggauu

SEQ ID NO: 949 - RNA, 17 nt, Artificial Sequence
  CEP290-B1249 targeting domain (RNA)
auaggacagaggacaug

SEQ ID NO: 950 - skipped

SEQ ID NO: 951 - RNA, 17 nt, Artificial Sequence
  CEP290-B1251 targeting domain (RNA)
aucagaaauagaggcuu

SEQ ID NO: 952 - RNA, 17 nt, Artificial Sequence
  CEP290-B1252 targeting domain (RNA)
aucauucuuguggcagu

SEQ ID NO: 953 - RNA, 17 nt, Artificial Sequence
  CEP290-B1253 targeting domain (RNA)
auccuccuuacugccac

SEQ ID NO: 954 - skipped

SEQ ID NO: 955 - RNA, 17 nt, Artificial Sequence
  CEP290-B1255 targeting domain (RNA)
aucuuccucaucagaaa

SEQ ID NO: 956 - skipped

SEQ ID NO: 957 - RNA, 17 nt, Artificial Sequence
  CEP290-B1260 targeting domain (RNA)
auuagaaaguccuaggc

SEQ ID NO: 958 - RNA, 17 nt, Artificial Sequence
  CEP290-B1261 targeting domain (RNA)
auucuuguggcaguaag

SEQ ID NO: 959 - RNA, 17 nt, Artificial Sequence
  CEP290-B1262 targeting domain (RNA)
cacucucauguauuagc

SEQ ID NO: 960 - RNA, 17 nt, Artificial Sequence
  CEP290-B1263 targeting domain (RNA)
cauaucugucuuccuua

SEQ ID NO: 961 - RNA, 17 nt, Artificial Sequence
  CEP290-B1264/-B1265 targeting domain
caugacucauaauuuag

SEQ ID NO: 962 - RNA, 17 nt, Artificial Sequence
  CEP290-B1266 targeting domain
caugagagugauuagug

SEQ ID NO: 963 - RNA, 17 nt, Artificial Sequence
  CEP290-B1267 targeting domain
ccuaggacuuucuaaug

SEQ ID NO: 964 - RNA, 17 nt, Artificial Sequence
  CEP290-B1268 trgeting domain
ccuauccucuccagcau

SEQ ID NO: 965 - skipped

SEQ ID NO: 966 - RNA, 17 nt, Artificial Sequence
  CEP290-B1270 targeting domain
cucaugucaucuagagc

SEQ ID NO: 967 - RNA, 17 nt, Artificial Sequence
  CEP290-B1271 targeting domain
cucuugcucuagaugac

SEQ ID NO: 968 - RNA, 17 nt, Artificial Sequence
  CEP290-B1272/-B1273 targeting domain (RNA)
cucuuuggcaaaagcag

SEQ ID NO: 969 - skipped

SEQ ID NO: 970 - RNA, 17 nt, Artificial Sequence
  CEP290-B1274 targeting domain (RNA)
cugaacaaguuuugaaa

SEQ ID NO: 971 - RNA, 17 nt, Artificial Sequence
  CEP290-B1275 targeting domain (RNA)
cugagcaaaacaacugg

SEQ ID NO: 972 - RNA, 17 nt, Artificial Sequence
  CEP290-B1276/-B1277 targeting domain (RNA)
cugcugcuuuugccaaa

SEQ ID NO: 973 - RNA, 17 nt, Artificial Sequence
  CEP290-B1278 targeting domain
cuggagaggauaggaca

SEQ ID NO: 974 - RNA, 17 nt, Artificial Sequence
  CEP290-B1279/-B1280 targeting domain (RNA)
uaaaugaaaacguuguu

SEQ ID NO: 975 - RNA, 17 nt, Artificial Sequence
  CEP290-B1281 targeting domain (RNA)
uaagcauacuuuuuuua

SEQ ID NO: 976 - RNA, 17 nt, Artificial Sequence
  CEP290-B1283 targeting domain (RNA)
uaaugccugaacaaguu

SEQ ID NO: 977 - RNA, 17 nt, Artificial Sequence
  CEP290-B1284 targeting domain (RNA)
uaauuuguuucugugug

SEQ ID NO: 978 - RNA, 17 nt, Artificial Sequence
  CEP290-B1285 targeting domain (RNA)
uacaaaagaacauacau

SEQ ID NO: 979 - RNA, 17 nt, Artificial Sequence
  CEP290-B1286 targeting domain (RNA)
uaggcaagagacaucuu

SEQ ID NO: 980 - RNA, 17 nt, Artificial Sequence
  CEP290-B1287 targeting domain (RNA)
uauaagucuuuugauau

SEQ ID NO: 981 - RNA, 17 nt, Artificial Sequence
  CEP290-B1288 targeting domain (RNA)
uaucuaagauccuuuca

SEQ ID NO: 982 - RNA, 17 nt, Artificial Sequence
  CEP290-B1289 targeting domain (RNA)
uauuucugaugaggaag

SEQ ID NO: 983 - RNA, 17 nt, Artificial Sequence
  CEP290-B1292 targeting domain (RNA)
uccaguuguuuugcuca

SEQ ID NO: 984 - RNA, 17 nt, Artificial Sequence
  CEP290-B1293 targeting domain (RNA)
ucuaaugcuggagagga

SEQ ID NO: 985-986 - skipped (2 entries)

SEQ ID NO: 987 - RNA, 17 nt, Artificial Sequence
  CEP290-B1298 targeting domain (RNA)
ugcagaacuaguguaga

SEQ ID NO: 988 - skipped

SEQ ID NO: 989 - RNA, 17 nt, Artificial Sequence
  CEP290-B1301 targeting domain (RNA)
ugcuggagaggauagga

SEQ ID NO: 990 - RNA, 17 nt, Artificial Sequence
  CEP290-B1303/-B1304 targeting domain (RNA)
uguuuaucaauauuauu

SEQ ID NO: 991 - RNA, 17 nt, Artificial Sequence
  CEP290-B1305 targeting domain (RNA)
uuaaaaaaaguaugcuu

SEQ ID NO: 992 - RNA, 17 nt, Artificial Sequence
  CEP290-B1306 targeting domain (RNA)
uuaaggcggggagucac

SEQ ID NO: 993 - RNA, 17 nt, Artificial Sequence
  CEP290-B1307/-B1308 targeting domain (RNA)
uuacugaaugugucucu

SEQ ID NO: 994 - skipped

SEQ ID NO: 995 - RNA, 17 nt, Artificial Sequence
  CEP290-B1310 targeting domain (RNA)
uucacugagcaaaacaa

SEQ ID NO: 996 - RNA, 17 nt, Artificial Sequence
  CEP290-B1311/-B1312 targeting domain (RNA)
uucugcugcuuuugcca

SEQ ID NO: 997 - RNA, 17 nt, Artificial Sequence
  CEP290-B1313 targeting domain (RNA)
uugaacucugugccaaa

SEQ ID NO: 998 - skipped

SEQ ID NO: 999 - RNA, 17 nt, Artificial Sequence
  CEP290-B1315 targeting domain (RNA)
uuguggauaauguauca

SEQ ID NO: 1000 - RNA, 17 nt, Artificial Sequence
  CEP290-B1316 targeting domain (RNA)
uuguucaucuuccucau

SEQ ID NO: 1001-1002 - skipped (2 entries)

SEQ ID NO: 1003 - RNA, 17 nt, Artificial Sequence
  CEP290-B1319 targeting domain (RNA)
uuuugacaguuuuuaag

SEQ ID NO: 1004 - RNA, 17 nt, Artificial Sequence
  CEP290-B235/-1967 targeting domain (RNA)
uucaagcuaauacauga

SEQ ID NO: 1005 - RNA, 17 nt, Artificial Sequence
  CEP290-B109/-1963 targeting domain (RNA)
cacaugggagucacagg

SEQ ID NO: 1006 - RNA, 20 nt, Artificial Sequence
  CEP290-B129/-1960 targeting domain (RNA)
agucacaugggagucacagg

SEQ ID NO: 1007 - RNA, 17 nt, Artificial Sequence
  CEP290-B295/-1939 targeting domain (RNA)
aauagaggcuuauggau

SEQ ID NO: 1008 - RNA, 17 nt, Artificial Sequence
  CEP290-B297/-1950 targeting domain (RNA)
cugaggacagaacaagc

SEQ ID NO: 1009 - RNA, 17 nt, Artificial Sequence
  CEP290-B298/-1948 targeting domain (RNA)
caucagaaauagaggcu

SEQ ID NO: 1010 - skipped

SEQ ID NO: 1011 - RNA, 17 nt, Artificial Sequence
  CEP290-B300/-B522/-1942 targeting domain (RNA)
agcagaaagcaaacuga

SEQ ID NO: 1012 - RNA, 17 nt, Artificial Sequence
  CEP290-B301/-B537/-1937 targeting domain (RNA)
aaaagcagcagaaagca

SEQ ID NO: 1013 - RNA, 20 nt, Artificial Sequence
  CEP290-B302/-1956 targeting domain (RNA)
uuacugaggacagaacaagc

SEQ ID NO: 1014 - RNA, 20 nt, Artificial Sequence
  CEP290-B303/-B504/-1938 targeting domain (RNA)
aacguuguucugaguagcuu

SEQ ID NO: 1015 - skipped

SEQ ID NO: 1016 - RNA, 20 nt, Artificial Sequence
  CEP290-B305/-1941 targeting domain (RNA)
agaaauagaggcuuauggau

SEQ ID NO: 1017 - RNA, 20 nt, Artificial Sequence
  CEP290-B306/-1949 targeting domain (RNA)
ccucaucagaaauagaggcu

SEQ ID NO: 1018 - RNA, 20 nt, Artificial Sequence
  CEP290-B307/-B526/-1943 targeting domain (RNA)
agcagcagaaagcaaacuga

SEQ ID NO: 1019-1024 - skipped (6 entries)

SEQ ID NO: 1025 - RNA, 24 nt, Artificial Sequence
  CEP290-35/-616 targeting domain (RNA)
aaauaaaacuaagacacugccaau

SEQ ID NO: 1026 - RNA, 23 nt, Artificial Sequence
  CEP290-36/-617 targeting domain (RNA)
aauaaaacuaagacacugccaau

SEQ ID NO: 1027 - RNA, 22 nt, Artificial Sequence
  CEP290-37/-618 targeting domain (RNA)
auaaaacuaagacacugccaau

SEQ ID NO: 1028 - RNA, 19 nt, Artificial Sequence
  CEP290-39/-620 targeting domain (RNA)
aaacuaagacacugccaau

SEQ ID NO: 1029 - RNA, 18 nt, Artificial Sequence
  CEP290-40/-621 targeting domain (RNA)
aacuaagacacugccaau

SEQ ID NO: 1030 - RNA, 24 nt, Artificial Sequence
  CEP290-17 targeting domain (RNA)
ccgcaccuggccccaguuguaauu

SEQ ID NO: 1031 - RNA, 23 nt, Artificial Sequence
  CEP290-41 targeting domain (RNA)
cgcaccuggccccaguuguaauu

SEQ ID NO: 1032 - RNA, 21 nt, Artificial Sequence
  CEP290-42 targeting domain (RNA)
caccuggccccaguuguaauu

SEQ ID NO: 1033 - RNA, 19 nt, Artificial Sequence
  CEP290-513 targeting domain (RNA)
ccuggccccaguuguaauu

SEQ ID NO: 1034 - RNA, 18 nt, Artificial Sequence
  CEP290-514 targeting domain (RNA)
cuggccccaguuguaauu

SEQ ID NO: 1035 - RNA, 21 nt, Artificial Sequence
  CEP290-43/-693 targeting domain (RNA)
uaaaacuaagacacugccaau

SEQ ID NO: 1036 - RNA, 24 nt, Artificial Sequence
  CEP290-44/-1448 targeting domain (RNA)
aaaauaaaacuaagacacugccaa

SEQ ID NO: 1037 - RNA, 23 nt, Artificial Sequence
  CEP290-45/-1449 targeting domain (RNA)
aaauaaaacuaagacacugccaa

SEQ ID NO: 1038 - RNA, 22 nt, Artificial Sequence
  CEP290-46/-1450 targeting domain (RNA)
aauaaaacuaagacacugccaa

SEQ ID NO: 1039 - RNA, 21 nt, Artificial Sequence
  CEP290-47/-1451 targeting domain (RNA)
auaaaacuaagacacugccaa

SEQ ID NO: 1040 - RNA, 19 nt, Artificial Sequence
  CEP290-48/-1452 targeting domain (RNA)
aaaacuaagacacugccaa

SEQ ID NO: 1041 - RNA, 18 nt, Artificial Sequence
  CEP290-49/-1453 targeting domain (RNA)
aaacuaagacacugccaa

SEQ ID NO: 1042 - RNA, 24 nt, Artificial Sequence
  CEP290-16 targeting domain (RNA)
aagacacugccaauagggauaggu

SEQ ID NO: 1043 - RNA, 23 nt, Artificial Sequence
  CEP290-50/-1366 targeting domain (RNA)
agacacugccaauagggauaggu

SEQ ID NO: 1044 - RNA, 21 nt, Artificial Sequence
  CEP290-51/-1367 targeting domain (RNA)
acacugccaauagggauaggu

SEQ ID NO: 1045 - RNA, 19 nt, Artificial Sequence
  CEP290-510 targeting domain (RNA)
acugccaauagggauaggu

SEQ ID NO: 1046 - RNA, 18 nt, Artificial Sequence
  CEP290-511 targeting domain (RNA)
cugccaauagggauaggu

SEQ ID NO: 1047 - RNA, 22 nt, Artificial Sequence
  CEP290-11 targeting domain (RNA)
gacacugccaauagggauaggu

SEQ ID NO: 1048 - skipped

SEQ ID NO: 1049 - RNA, 22 nt, Artificial Sequence
  CEP290-13 targeting domain (RNA)
augagauacucacaauuacaac

SEQ ID NO: 1050 - RNA, 19 nt, Artificial Sequence
  CEP290-53 targeting domain (RNA)
agauacucacaauuacaac

SEQ ID NO: 1051 - RNA, 24 nt, Artificial Sequence
  CEP290-18 targeting sequence (RNA)
guaugagauacucacaauuacaac

SEQ ID NO: 1052 - RNA, 18 nt, Artificial Sequence
  CEP290-55 targeting domain (RNA)
gauacucacaauuacaac

SEQ ID NO: 1053 - RNA, 23 nt, Artificial Sequence
  CEP290-14 targeting domain (RNA)
uaugagauacucacaauuacaac

SEQ ID NO: 1054 - RNA, 21 nt, Artificial Sequence
  CEP290-57 targeting domain (RNA)
ugagauacucacaauuacaac

SEQ ID NO: 1055 - RNA, 21 nt, Artificial Sequence
  CEP290-58 targeting domain (RNA)
augagauauucacaauuacaa

SEQ ID NO: 1056 - RNA, 18 nt, Artificial Sequence
  CEP290-59 targeting domain (RNA)
agauauucacaauuacaa

SEQ ID NO: 1057 - RNA, 24 nt, Artificial Sequence
  CEP290-19 targeting domain (RNA)
gguaugagauauucacaauuacaa

SEQ ID NO: 1058 - RNA, 23 nt, Artificial Sequence
  CEP290-61 targeting domain (RNA)
guaugagauauucacaauuacaa

SEQ ID NO: 1059 - RNA, 19 nt, Artificial Sequence
  CEP290-63 targeting domain (RNA)
gagauauucacaauuacaa

SEQ ID NO: 1060 - RNA, 22 nt, Artificial Sequence
  CEP290-65 targeting domain (RNA)
uaugagauauucacaauuacaa

SEQ ID NO: 1061 - RNA, 20 nt, Artificial Sequence
  CEP290-66 targeting domain (RNA)
ugagauauucacaauuacaa

SEQ ID NO: 1062 - RNA, 17 nt, Artificial Sequence
  CEP290-121 targeting domain (RNA)
aaaaaggagcaugaaac

SEQ ID NO: 1063-1065 - skipped (3 entries)

SEQ ID NO: 1066 - RNA, 20 nt, Artificial Sequence
  CEP290-129 targeting domain (RNA)
aaagaaauagauguagauug

SEQ ID NO: 1067-1069 - skipped (3 entries)

SEQ ID NO: 1070 - RNA, 17 nt, Artificial Sequence
  CEP290-135 targeting domain (RNA)
aacaaacuauucuccca

SEQ ID NO: 1071 - RNA, 20 nt, Artificial Sequence
  CEP290-136 targeting domain (RNA)
aacaguagcugaaauauuaa

SEQ ID NO: 1072 - skipped

SEQ ID NO: 1073 - RNA, 20 nt, Artificial Sequence
  CEP290-138 targeting domain (RNA)
aacuauucucccaugguccc

SEQ ID NO: 1074 - RNA, 20 nt, Artificial Sequence
  CEP290-141 targeting domain (RNA)
aaggaaauacaaaaacugga

SEQ ID NO: 1075 - RNA, 17 nt, Artificial Sequence
  CEP290-142 targeting domain (RNA)
aagguauagaguucaag

SEQ ID NO: 1076 - RNA, 17 nt, Artificial Sequence
  CEP290-143 targeting domain (RNA)
aagguucaugagacuag

SEQ ID NO: 1077 - RNA, 20 nt, Artificial Sequence
  CEP290-144 targeting domain (RNA)
aauaguuuguucuggguaca

SEQ ID NO: 1078 - skipped

SEQ ID NO: 1079 - RNA, 20 nt, Artificial Sequence
  CEP290-146 targeting domain (RNA)
aauauauuaucuauuuauag

SEQ ID NO: 1080 - RNA, 17 nt, Artificial Sequence
  CEP290-147 targeting domain (RNA)
aauauuguaaucaaagg

SEQ ID NO: 1081 - RNA, 17 nt, Artificial Sequence
  CEP290-148 targeting domain (RNA)
aauauuucagcuacugu

SEQ ID NO: 1082 - RNA, 20 nt, Artificial Sequence
  CEP290-149 targeting domain (RNA)
aauuauuguugcuuuuugag

SEQ ID NO: 1083 - skipped

SEQ ID NO: 1084 - RNA, 17 nt, Artificial Sequence
  CEP290-151 targeting domain (RNA)
acaaaagccagggacca

SEQ ID NO: 1085 - RNA, 20 nt, Artificial Sequence
  CEP290-153/-1200 targeting domain (RNA)
acagagugcauccauggucc

SEQ ID NO: 1086 - skipped

SEQ ID NO: 1087 - RNA, 20 nt, Artificial Sequence
  CEP290-155/-1080 targeting domain (RNA)
accagacaucuaagagaaaa

SEQ ID NO: 1088 - skipped

SEQ ID NO: 1089 - RNA, 20 nt, Artificial Sequence
  CEP290-159/-1228 targeting domain (RNA)
agaauauuguaaucaaagga

SEQ ID NO: 1090 - RNA, 17 nt, Artificial Sequence
  CEP290-160 targeting domain (RNA)
agacaucuaagagaaaa

SEQ ID NO: 1091-1092 - skipped (2 entries)

SEQ ID NO: 1093 - RNA, 17 nt, Artificial Sequence
  CEP290-164 targeting domain (RNA)
agaugucugguuaaaag

SEQ ID NO: 1094-1095 - skipped (2 entries)

SEQ ID NO: 1096 - RNA, 20 nt, Artificial Sequence
  CEP290-168 targeting domain (RNA)
aggaaauacaaaaacuggau

SEQ ID NO: 1097-1100 - skipped (4 entries)

SEQ ID NO: 1101 - RNA, 20 nt, Artificial Sequence
  CEP290-173/-1238 targeting domain (RNA)
agguagaauauuguaaucaa

SEQ ID NO: 1102 - RNA, 17 nt, Artificial Sequence
  CEP290-174 targeting domain (RNA)
aguagcugaaauauuaa

SEQ ID NO: 1103 - RNA, 17 nt, Artificial Sequence
  CEP290-177 targeting domain (RNA)
aguuuguucuggguaca

SEQ ID NO: 1104-1106 - skipped (3 entries)

SEQ ID NO: 1107 - RNA, 20 nt, Artificial Sequence
  CEP290-181 targeting domain (RNA)
auaguuuguucuggguacag

SEQ ID NO: 1108 - skipped

SEQ ID NO: 1109 - RNA, 17 nt, Artificial Sequence
  CEP290-183 targeting domain (RNA)
auauuaagggcucuucc

SEQ ID NO: 1110 - RNA, 17 nt, Artificial Sequence
  CEP290-184 targeting domain (RNA)
auauuguaaucaaagga

SEQ ID NO: 1111 - RNA, 17 nt, Artificial Sequence
  CEP290-185 targeting domain (RNA)
aucaugcaagugaccua

SEQ ID NO: 1112-1115 - skipped (4 entries)

SEQ ID NO: 1116 - RNA, 20 nt, Artificial Sequence
  CEP290-192 targeting domain (RNA)
augggagaauaguuuguucu

SEQ ID NO: 1117 - skipped

SEQ ID NO: 1118 - RNA, 20 nt, Artificial Sequence
  CEP290-195 targeting domain (RNA)
auuccaaggaacaaaagcca

SEQ ID NO: 1119 - RNA, 20 nt, Artificial Sequence
  CEP290-196 targeting domain (RNA)
auugagguagaaucaagaag

SEQ ID NO: 1120 - RNA, 17 nt, Artificial Sequence
  CEP290-198 targeting domain (RNA)
caaaagccagggaccau

SEQ ID NO: 1121 - RNA, 20 nt, Artificial Sequence
  CEP290-199 targeting domain (RNA)
caacaguagcugaaauauua

SEQ ID NO: 1122 - skipped

SEQ ID NO: 1123 - RNA, 20 nt, Artificial Sequence
  CEP290-201 targeting domain (RNA)
cagaacaaacuauucuccca

SEQ ID NO: 1124 - RNA, 20 nt, Artificial Sequence
  CEP290-202/-650 targeting domain (RNA)
cagauuucaugugugaagaa

SEQ ID NO: 1125 - skipped

SEQ ID NO: 1126 - RNA, 20 nt, Artificial Sequence
  CEP290-205 targeting domain (RNA)
cagggguaagagaaagggau

SEQ ID NO: 1127 - skipped

SEQ ID NO: 1128 - RNA, 17 nt, Artificial Sequence
  CEP290-207 targeting domain (RNA)
caguagcugaaauauua

SEQ ID NO: 1129 - skipped

SEQ ID NO: 1130 - RNA, 20 nt, Artificial Sequence
  CEP290-209 targeting domain (RNA)
caugggagaauaguuuguuc

SEQ ID NO: 1131 - RNA, 20 nt, Artificial Sequence
  CEP290-211/-1104 targeting domain (RNA)
cauuccaaggaacaaaagcc

SEQ ID NO: 1132-1139 - skipped (8 entries)

SEQ ID NO: 1140 - RNA, 20 nt, Artificial Sequence
  CEP290-226 targeting domain (RNA)
cuggcuuuuguuccuuggaa

SEQ ID NO: 1141 - RNA, 17 nt, Artificial Sequence
  CEP290-227 targeting domain (RNA)
cuguaagauaacuacaa

SEQ ID NO: 1142 - skipped

SEQ ID NO: 1143 - RNA, 20 nt, Artificial Sequence
  CEP290-229 targeting domain (RNA)
cuuaauauuucagcuacugu

SEQ ID NO: 1144 - RNA, 20 nt, Artificial Sequence
  CEP290-231 targeting domain (RNA)
cuuagaugucugguuaaaag

SEQ ID NO: 1145-1147 - skipped (3 entries)

SEQ ID NO: 1148 - RNA, 17 nt, Artificial Sequence
  CEP290-236 targeting domain (RNA)
gaaauacaaaaacugga

SEQ ID NO: 1149 - RNA, 20 nt, Artificial Sequence
  CEP290-239 targeting domain (RNA)
ggagugcaguggagugaucu

SEQ ID NO: 1150 - RNA, 17 nt, Artificial Sequence
  CEP290-240 targeting domain (RNA)
gggguaagagaaaggga

SEQ ID NO: 1151 - RNA, 17 nt, Artificial Sequence
  CEP290-241 targeting domain (RNA)
ggguaagagaaagggau

SEQ ID NO: 1152 - RNA, 17 nt, Artificial Sequence
  CEP290-242 targeting domain (RNA)
gucucacuguguugccc

SEQ ID NO: 1153 - RNA, 17 nt, Artificial Sequence
  CEP290-243 targeting domain (RNA)
gugcaguggagugaucu

SEQ ID NO: 1154 - RNA, 20 nt, Artificial Sequence
  CEP290-244/-973 targeting domain (RNA)
guguguguguguguguuaug

SEQ ID NO: 1155 - RNA, 17 nt, Artificial Sequence
  CEP290-245 targeting domain (RNA)
guguguguguguuaugu

SEQ ID NO: 1156 - RNA, 17 nt, Artificial Sequence
  CEP290-246 targeting domain (RNA)
aaauacaaaaacuggau

SEQ ID NO: 1157-1159 - skipped (3 entries)

SEQ ID NO: 1160 - RNA, 20 nt, Artificial Sequence
  CEP290-251 targeting domain (RNA)
acagggguaagagaaaggga

SEQ ID NO: 1161 - RNA, 20 nt, Artificial Sequence
  CEP290-254 targeting domain (RNA)
acuccacugcacuccagccu

SEQ ID NO: 1162 - skipped

SEQ ID NO: 1163 - RNA, 20 nt, Artificial Sequence
  CEP290-256 targeting domain (RNA)
agagucucacuguguugccc

SEQ ID NO: 1164 - skipped

SEQ ID NO: 1165 - RNA, 17 nt, Artificial Sequence
  CEP290-258 targeting domain (RNA)
auauuaucuauuuauag

SEQ ID NO: 1166 - RNA, 17 nt, Artificial Sequence
  CEP290-259 targeting domain (RNA)
auuucaugugugaagaa

SEQ ID NO: 1167-1168 - skipped (2 entries)

SEQ ID NO: 1169 - RNA, 20 nt, Artificial Sequence
  CEP290-262 targeting domain (RNA)
cacuccacugcacuccagcc

SEQ ID NO: 1170 - RNA, 17 nt, Artificial Sequence
  CEP290-263 targeting domain (RNA)
cacuguguugcccaggc

SEQ ID NO: 1171 - RNA, 17 nt, Artificial Sequence
  CEP290-264 targeting domain (RNA)
ccaaggaacaaaagcca

SEQ ID NO: 1172 - RNA, 17 nt, Artificial Sequence
  CEP290-265 targeting domain (RNA)
ccacugcacuccagccu

SEQ ID NO: 1173 - RNA, 17 nt, Artificial Sequence
  CEP290-266 targeting domain (RNA)
cccaggcuggagugcag

SEQ ID NO: 1174 - RNA, 17 nt, Artificial Sequence
  CEP290-267 targeting domain (RNA)
cccuggcuuuuguuccu

SEQ ID NO: 1175 - RNA, 20 nt, Artificial Sequence
  CEP290-268 targeting domain (RNA)
cgcuugaaccugggaggcag

SEQ ID NO: 1176 - RNA, 17 nt, Artificial Sequence
  CEP290-269 targeting domain (RNA)
uaaggaaauacaaaaac

SEQ ID NO: 1177 - RNA, 20 nt, Artificial Sequence
  CEP290-270 targeting domain (RNA)
uaauaaggaaauacaaaaac

SEQ ID NO: 1178 - RNA, 20 nt, Artificial Sequence
  CEP290-271 targeting domain (RNA)
uacugcaaccucugccuccc

SEQ ID NO: 1179-1180 - skipped (2 entries)

SEQ ID NO: 1181 - RNA, 17 nt, Artificial Sequence
  CEP290-274 targeting domain (RNA)
uccacugcacuccagcc

SEQ ID NO: 1182 - RNA, 20 nt, Artificial Sequence
  CEP290-275/-784 targeting domain (RNA)
ucucacuguguugcccaggc

SEQ ID NO: 1183 - skipped

SEQ ID NO: 1184 - RNA, 17 nt, Artificial Sequence
  CEP290-277 targeting domain (RNA)
ugcaaccucugccuccc

SEQ ID NO: 1185 - RNA, 20 nt, Artificial Sequence
  CEP290-278/-1197 targeting domain (RNA)
uguguguguguguguuaugu

SEQ ID NO: 1186 - RNA, 17 nt, Artificial Sequence
  CEP290-279 targeting domain (RNA)
uguguguguguguuaug

SEQ ID NO: 1187 - skipped

SEQ ID NO: 1188 - RNA, 17 nt, Artificial Sequence
  CEP290-281 targeting domain (RNA)
uugaaccugggaggcag

SEQ ID NO: 1189 - RNA, 20 nt, Artificial Sequence
  CEP290-282/-773 targeting domain (RNA)
uugcccaggcuggagugcag

SEQ ID NO: 1190 - skipped

SEQ ID NO: 1191 - RNA, 21 nt, Artificial Sequence
  CEP290-337 targeting domain (RNA)
aaaucaugcaagugaccuaag

SEQ ID NO: 1192 - RNA, 20 nt, Artificial Sequence
  CEP290-338 targeting domain (RNA)
aaucaugcaagugaccuaag

SEQ ID NO: 1193 - RNA, 19 nt, Artificial Sequence
  CEP290-339 targeting domain (RNA)
aucaugcaagugaccuaag

SEQ ID NO: 1194 - RNA, 20 nt, Artificial Sequence
  CEP290-340 targeting domain (RNA)
aggucacuugcaugauuuag

SEQ ID NO: 1195 - RNA, 24 nt, Artificial Sequence
  CEP290-341 targeting domain (RNA)
aauauuaagggcucuuccuggacc

SEQ ID NO: 1196 - RNA, 23 nt, Artificial Sequence
  CEP290-342 targeting domain (RNA)
auauuaagggcucuuccuggacc

SEQ ID NO: 1197 - RNA, 21 nt, Artificial Sequence
  CEP290-343 targeting domain (RNA)
auuaagggcucuuccuggacc

SEQ ID NO: 1198 - RNA, 18 nt, Artificial Sequence
  CEP290-344 targeting domain (RNA)
aagggcucuuccuggacc

SEQ ID NO: 1199 - RNA, 19 nt, Artificial Sequence
  CEP290-345 targeting domain (RNA)
aggacuuucuaaugcugga

SEQ ID NO: 1200 - RNA, 21 nt, Artificial Sequence
  CEP290-346 targeting domain (RNA)
accaugggagaauaguuuguu

SEQ ID NO: 1201 - RNA, 18 nt, Artificial Sequence
  CEP290-347 targeting domain (RNA)
augggagaauaguuuguu

SEQ ID NO: 1202 - RNA, 23 nt, Artificial Sequence
  CEP290-348 targeting domain (RNA)
acuccugugaaaggaucuuagau

SEQ ID NO: 1203 - RNA, 23 nt, Artificial Sequence
  CEP290-349 targeting domain (RNA)
aaaacguuguucugaguagcuuu

SEQ ID NO: 1204 - RNA, 22 nt, Artificial Sequence
  CEP290-350 targeting domain (RNA)
aaacguuguucugaguagcuuu

SEQ ID NO: 1205 - RNA, 21 nt, Artificial Sequence
  CEP290-351 targeting domain (RNA)
aacguuguucugaguagcuuu

SEQ ID NO: 1206 - skipped

SEQ ID NO: 1207 - RNA, 22 nt, Artificial Sequence
  CEP290-353 targeting domain (RNA)
auuuauaguggcugaaugacuu

SEQ ID NO: 1208 - RNA, 18 nt, Artificial Sequence
  CEP290-354 targeting domain (RNA)
auaguggcugaaugacuu

SEQ ID NO: 1209 - RNA, 22 nt, Artificial Sequence
  CEP290-355 targeting domain (RNA)
auggucccuggcuuuuguuccu

SEQ ID NO: 1210 - RNA, 24 nt, Artificial Sequence
  CEP290-356 targeting domain (RNA)
agacaucuuguggauaauguauca

SEQ ID NO: 1211 - RNA, 22 nt, Artificial Sequence
  CEP290-357 targeting domain (RNA)
acaucuuguggauaauguauca

SEQ ID NO: 1212 - skipped

SEQ ID NO: 1213 - RNA, 24 nt, Artificial Sequence
  CEP290-359 targeting domain (RNA)
aaaguccuaggcaagagacaucuu

SEQ ID NO: 1214 - RNA, 23 nt, Artificial Sequence
  CEP290-360 targeting domain (RNA)
aaguccuaggcaagagacaucuu

SEQ ID NO: 1215 - RNA, 22 nt, Artificial Sequence
  CEP290-361 targeting domain (RNA)
aguccuaggcaagagacaucuu

SEQ ID NO: 1216 - RNA, 24 nt, Artificial Sequence
  CEP290-362 targeting domain
agccagcaaaagcuuuugagcuaa

SEQ ID NO: 1217 - skipped

SEQ ID NO: 1218 - RNA, 22 nt, Artificial Sequence
  CEP290-364 targeting domain (RNA)
agaucuuauucuacuccuguga

SEQ ID NO: 1219 - skipped

SEQ ID NO: 1220 - RNA, 22 nt, Artificial Sequence
  CEP290-366 targeting domain (RNA)
aucuaagauccuuucacaggag

SEQ ID NO: 1221 - RNA, 18 nt, Artificial Sequence
  CEP290-369 targeting domain (RNA)
aagauccuuucacaggag

SEQ ID NO: 1222 - RNA, 24 nt, Artificial Sequence
  CEP290-370 targeting domain (RNA)
agcuuucaggauuccuacuaaauu

SEQ ID NO: 1223 - RNA, 23 nt, Artificial Sequence
  CEP290-371 targeting domain (RNA)
acucagaacaacguuuucauuua

SEQ ID NO: 1224 - RNA, 19 nt, Artificial Sequence
  CEP290-372 targeting domain (RNA)
agaacaacguuuucauuua

SEQ ID NO: 1225 - RNA, 22 nt, Artificial Sequence
  CEP290-373 targeting domain (RNA)
agaauaucauaaguuacaaucu

SEQ ID NO: 1226 - RNA, 20 nt, Artificial Sequence
  CEP290-375 targeting domain (RNA)
aauaucauaaguuacaaucu

SEQ ID NO: 1227 - RNA, 19 nt, Artificial Sequence
  CEP290-376 targeting domain (RNA)
auaucauaaguuacaaucu

SEQ ID NO: 1228 - RNA, 22 nt, Artificial Sequence
  CEP290-377 targeting domain (RNA)
aaguggcuguaagauaacuaca

SEQ ID NO: 1229 - RNA, 21 nt, Artificial Sequence
  CEP290-378 targeting domain (RNA)
aguggcuguaagauaacuaca

SEQ ID NO: 1230 - RNA, 24 nt, Artificial Sequence
  CEP290-379 targeting domain (RNA)
auguuuaacguuaucauuuuccca

SEQ ID NO: 1231 - RNA, 18 nt, Artificial Sequence
  CEP290-380 targeting domain (RNA)
aacguuaucauuuuccca

SEQ ID NO: 1232 - RNA, 22 nt, Artificial Sequence
  CEP290-381 targeting domain (RNA)
aagagaaagggaugggcacuua

SEQ ID NO: 1233 - RNA, 21 nt, Artificial Sequence
  CEP290-382 targeting domain (RNA)
agagaaagggaugggcacuua

SEQ ID NO: 1234 - RNA, 19 nt, Artificial Sequence
  CEP290-383 targeting domain (RNA)
agaaagggaugggcacuua

SEQ ID NO: 1235 - RNA, 23 nt, Artificial Sequence
  CEP290-384 targeting domain (RNA)
auucaguaaaugaaaacguuguu

SEQ ID NO: 1236 - RNA, 19 nt, Artificial Sequence
  CEP290-385 targeting domain (RNA)
aguaaaugaaaacguuguu

SEQ ID NO: 1237 - RNA, 23 nt, Artificial Sequence
  CEP290-386 targeting domain (RNA)
auaaacaugacucauaauuuagu

SEQ ID NO: 1238 - RNA, 21 nt, Artificial Sequence
  CEP290-387 targeting domain (RNA)
aaacaugacucauaauuuagu

SEQ ID NO: 1239 - skipped

SEQ ID NO: 1240 - RNA, 19 nt, Artificial Sequence
  CEP290-389 targeting domain (RNA)
acaugacucauaauuuagu

SEQ ID NO: 1241 - RNA, 23 nt, Artificial Sequence
  CEP290-390 targeting domain (RNA)
auucuuaucuaagauccuuucac

SEQ ID NO: 1242 - RNA, 24 nt, Artificial Sequence
  CEP290-391 targeting domain (RNA)
aggaacaaaagccagggaccaugg

SEQ ID NO: 1243 - RNA, 21 nt, Artificial Sequence
  CEP290-392 targeting domain (RNA)
aacaaaagccagggaccaugg

SEQ ID NO: 1244 - RNA, 20 nt, Artificial Sequence
  CEP290-393 targeting domain (RNA)
acaaaagccagggaccaugg

SEQ ID NO: 1245 - RNA, 18 nt, Artificial Sequence
  CEP290-394 targeting domain (RNA)
aaaagccagggaccaugg

SEQ ID NO: 1246 - RNA, 21 nt, Artificial Sequence
  CEP290-395 targeting domain (RNA)
agaauaguuuguucuggguac

SEQ ID NO: 1247 - RNA, 19 nt, Artificial Sequence
  CEP290-396 targeting domain (RNA)
aauaguuuguucuggguac

SEQ ID NO: 1248 - RNA, 18 nt, Artificial Sequence
  CEP290-397 targeting domain (RNA)
auaguuuguucuggguac

SEQ ID NO: 1249 - RNA, 24 nt, Artificial Sequence
  CEP290-398 targeting domain (RNA)
aucagaaauagaggcuuauggauu

SEQ ID NO: 1250 - RNA, 21 nt, Artificial Sequence
  CEP290-399 targeting domain (RNA)
agaaauagaggcuuauggauu

SEQ ID NO: 1251 - RNA, 19 nt, Artificial Sequence
  CEP290-400 targeting domain (RNA)
aaauagaggcuuauggauu

SEQ ID NO: 1252 - RNA, 18 nt, Artificial Sequence
  CEP290-401 targeting domain (RNA)
aauagaggcuuauggauu

SEQ ID NO: 1253 - RNA, 23 nt, Artificial Sequence
  CEP290-402 targeting domain (RNA)
aauauauuaucuauuuauagugg

SEQ ID NO: 1254 - RNA, 22 nt, Artificial Sequence
  CEP290-403 targeting domain (RNA)
auauauuaucuauuuauagugg

SEQ ID NO: 1255 - RNA, 20 nt, Artificial Sequence
  CEP290-404 targeting domain (RNA)
auauuaucuauuuauagugg

SEQ ID NO: 1256 - RNA, 18 nt, Artificial Sequence
  CEP290-405 targeting domain (RNA)
auuaucuauuuauagugg

SEQ ID NO: 1257 - RNA, 22 nt, Artificial Sequence
  CEP290-406 targeting domain (RNA)
aaauucucaucauuuuuuauug

SEQ ID NO: 1258 - RNA, 21 nt, Artificial Sequence
  CEP290-407 targeting domain (RNA)
aauucucaucauuuuuuauug

SEQ ID NO: 1259 - RNA, 20 nt, Artificial Sequence
  CEP290-408 targeting domain (RNA)
auucucaucauuuuuuauug

SEQ ID NO: 1260 - RNA, 22 nt, Artificial Sequence
  CEP290-409 targeting domain (RNA)
agaggauaggacagaggacaug

SEQ ID NO: 1261 - skipped

SEQ ID NO: 1262 - RNA, 23 nt, Artificial Sequence
  CEP290-411 targeting domain (RNA)
agaauaaauguagaauuuuaaug

SEQ ID NO: 1263 - RNA, 21 nt, Artificial Sequence
  CEP290-412 targeting domain (RNA)
aauaaauguagaauuuuaaug

SEQ ID NO: 1264 - RNA, 20 nt, Artificial Sequence
  CEP290-413 targeting domain (RNA)
auaaauguagaauuuuaaug

SEQ ID NO: 1265 - RNA, 18 nt, Artificial Sequence
  CEP290-414 targeting domain (RNA)
aaauguagaauuuuaaug

SEQ ID NO: 1266 - RNA, 22 nt, Artificial Sequence
  CEP290-415 targeting domain (RNA)
auuuuuuauuguagaauaaaug

SEQ ID NO: 1267 - RNA, 23 nt, Artificial Sequence
  CEP290-416 targeting domain (RNA)
cuaaaucaugcaagugaccuaag

SEQ ID NO: 1268 - RNA, 24 nt, Artificial Sequence
  CEP290-417 targeting domain (RNA)
ccuuaggucacuugcaugauuuag

SEQ ID NO: 1269 - RNA, 23 nt, Artificial Sequence
  CEP290-418 targeting domain (RNA)
cuuaggucacuugcaugauuuag

SEQ ID NO: 1270 - RNA, 22 nt, Artificial Sequence
  CEP290-419 targeting domain (RNA)
ccuaggacuuucuaaugcugga

SEQ ID NO: 1271 - RNA, 21 nt, Artificial Sequence
  CEP290-420 targeting domain (RNA)
cuaggacuuucuaaugcugga

SEQ ID NO: 1272 - RNA, 20 nt, Artificial Sequence
  CEP290-421 targeting domain (RNA)
ccaugggagaauaguuuguu

SEQ ID NO: 1273 - RNA, 19 nt, Artificial Sequence
  CEP290-422 targeting domain (RNA)
caugggagaauaguuuguu

SEQ ID NO: 1274 - RNA, 22 nt, Artificial Sequence
  CEP290-423 targeting domain (RNA)
cuccugugaaaggaucuuagau

SEQ ID NO: 1275 - skipped

SEQ ID NO: 1276 - RNA, 19 nt, Artificial Sequence
  CEP290-426 targeting domain (RNA)
cugugaaaggaucuuagau

SEQ ID NO: 1277 - RNA, 21 nt, Artificial Sequence
  CEP290-427 targeting domain (RNA)
cccuggcuuuuguuccuugga

SEQ ID NO: 1278 - RNA, 20 nt, Artificial Sequence
  CEP290-428 targeting domain (RNA)
ccuggcuuuuguuccuugga

SEQ ID NO: 1279 - RNA, 19 nt, Artificial Sequence
  CEP290-429 targeting domain (RNA)
cuggcuuuuguuccuugga

SEQ ID NO: 1280 - RNA, 19 nt, Artificial Sequence
  CEP290-430 targeting domain (RNA)
cguuguucugaguagcuuu

SEQ ID NO: 1281 - RNA, 24 nt, Artificial Sequence
  CEP290-431 targeting domain (RNA)
cuauuuauaguggcugaaugacuu

SEQ ID NO: 1282 - RNA, 24 nt, Artificial Sequence
  CEP290-432 targeting domain (RNA)
ccauggucccuggcuuuuguuccu

SEQ ID NO: 1283 - RNA, 23 nt, Artificial Sequence
  CEP290-433 targeting domain (RNA)
cauggucccuggcuuuuguuccu

SEQ ID NO: 1284 - RNA, 21 nt, Artificial Sequence
  CEP290-434 targeting domain (RNA)
caucuuguggauaauguauca

SEQ ID NO: 1285 - RNA, 18 nt, Artificial Sequence
  CEP290-435 targeting domain (RNA)
cuuguggauaauguauca

SEQ ID NO: 1286 - RNA, 19 nt, Artificial Sequence
  CEP290-437 targeting domain (RNA)
ccuaggcaagagacaucuu

SEQ ID NO: 1287 - RNA, 18 nt, Artificial Sequence
  CEP290-438 targeting domain (RNA)
cuaggcaagagacaucuu

SEQ ID NO: 1288 - RNA, 22 nt, Artificial Sequence
  CEP290-439 targeting domain (RNA)
ccagcaaaagcuuuugagcuaa

SEQ ID NO: 1289 - RNA, 21 nt, Artificial Sequence
  CEP290-440 targeting domain (RNA)
cagcaaaagcuuuugagcuaa

SEQ ID NO: 1290 - RNA, 18 nt, Artificial Sequence
  CEP290-441 targeting domain (RNA)
caaaagcuuuugagcuaa

SEQ ID NO: 1291 - RNA, 18 nt, Artificial Sequence
  CEP290-442 targeting domain (RNA)
cuuauucuacuccuguga

SEQ ID NO: 1292 - skipped

SEQ ID NO: 1293 - RNA, 24 nt, Artificial Sequence
  CEP290-444 targeting domain (RNA)
cuuccucaucagaaauagaggcuu

SEQ ID NO: 1294 - RNA, 21 nt, Artificial Sequence
  CEP290-445 targeting domain (RNA)
ccucaucagaaauagaggcuu

SEQ ID NO: 1295 - skipped

SEQ ID NO: 1296 - RNA, 18 nt, Artificial Sequence
  CEP290-447 targeting domain (RNA)
caucagaaauagaggcuu

SEQ ID NO: 1297 - RNA, 22 nt, Artificial Sequence
  CEP290-448 targeting domain (RNA)
cuuucaggauuccuacuaaauu

SEQ ID NO: 1298 - RNA, 18 nt, Artificial Sequence
  CEP290-449 targeting domain (RNA)
caggauuccuacuaaauu

SEQ ID NO: 1299 - RNA, 19 nt, Artificial Sequence
  CEP290-450 targeting domain (RNA)
cuguccucaguaaaaggua

SEQ ID NO: 1300 - RNA, 22 nt, Artificial Sequence
  CEP290-451 targeting domain (RNA)
cucagaacaacguuuucauuua

SEQ ID NO: 1301 - skipped

SEQ ID NO: 1302 - RNA, 23 nt, Artificial Sequence
  CEP290-453 targeting domain (RNA)
caaguggcuguaagauaacuaca

SEQ ID NO: 1303 - RNA, 24 nt, Artificial Sequence
  CEP290-454 targeting domain (RNA)
cauucaguaaaugaaaacguuguu

SEQ ID NO: 1304 - skipped

SEQ ID NO: 1305 - RNA, 18 nt, Artificial Sequence
  CEP290-458 targeting domain (RNA)
caugacucauaauuuagu

SEQ ID NO: 1306 - skipped

SEQ ID NO: 1307 - RNA, 19 nt, Artificial Sequence
  CEP290-460 targeting domain (RNA)
caaaagccagggaccaugg

SEQ ID NO: 1308 - RNA, 22 nt, Artificial Sequence
  CEP290-461 targeting domain (RNA)
cagaaauagaggcuuauggauu

SEQ ID NO: 1309 - RNA, 21 nt, Artificial Sequence
  CEP290-462 targeting domain (RNA)
cuggguacagggguaagagaa

SEQ ID NO: 1310 - RNA, 24 nt, Artificial Sequence
  CEP290-463 targeting domain (RNA)
caauauauuaucuauuuauagugg

SEQ ID NO: 1311 - RNA, 23 nt, Artificial Sequence
  CEP290-464 targeting domain (RNA)
cauuuuuuauuguagaauaaaug

SEQ ID NO: 1312 - RNA, 22 nt, Artificial Sequence
  Targeting domain
uaaaucaugcaagugaccuaag

SEQ ID NO: 1313 - RNA, 18 nt, Artificial Sequence
  Targeting domain
ucaugcaagugaccuaag

SEQ ID NO: 1314 - RNA, 22 nt, Artificial Sequence
  Targeting domain
uuaggucacuugcaugauuuag

SEQ ID NO: 1315 - RNA, 21 nt, Artificial Sequence
  Targeting domain
uaggucacuugcaugauuuag

SEQ ID NO: 1316 - RNA, 22 nt, Artificial Sequence
  Targeting domain
uauuaagggcucuuccuggacc

SEQ ID NO: 1317 - RNA, 20 nt, Artificial Sequence
  Targeting domain
uuaagggcucuuccuggacc

SEQ ID NO: 1318 - RNA, 19 nt, Artificial Sequence
  Targeting domain
uaagggcucuuccuggacc

SEQ ID NO: 1319 - RNA, 24 nt, Artificial Sequence
  Targeting domain
ugccuaggacuuucuaaugcugga

SEQ ID NO: 1320 - skipped

SEQ ID NO: 1321 - RNA, 24 nt, Artificial Sequence
  CEP290-474 targeting domain (RNA)
uacuccugugaaaggaucuuagau

SEQ ID NO: 1322 - RNA, 21 nt, Artificial Sequence
  Targeting domain
uccugugaaaggaucuuagau

SEQ ID NO: 1323 - RNA, 18 nt, Artificial Sequence
  Targeting domain
ugugaaaggaucuuagau

SEQ ID NO: 1324 - RNA, 22 nt, Artificial Sequence
  Targeting domain
ucccuggcuuuuguuccuugga

SEQ ID NO: 1325 - RNA, 18 nt, Artificial Sequence
  Targeting domain
uggcuuuuguuccuugga

SEQ ID NO: 1326 - RNA, 23 nt, Artificial Sequence
  Targeting domain
uauuuauaguggcugaaugacuu

SEQ ID NO: 1327 - RNA, 21 nt, Artificial Sequence
  Targeting domain
uuuauaguggcugaaugacuu

SEQ ID NO: 1328 - RNA, 20 nt, Artificial Sequence
  Targeting domain
uuauaguggcugaaugacuu

SEQ ID NO: 1329 - RNA, 19 nt, Artificial Sequence
  Targeting domain
uauaguggcugaaugacuu

SEQ ID NO: 1330 - RNA, 21 nt, Artificial Sequence
  Targeting domain
uggucccuggcuuuuguuccu

SEQ ID NO: 1331 - RNA, 18 nt, Artificial Sequence
  Targeting domain
ucccuggcuuuuguuccu

SEQ ID NO: 1332 - RNA, 19 nt, Artificial Sequence
  Targeting domain
ucuuguggauaauguauca

SEQ ID NO: 1333 - skipped

SEQ ID NO: 1334 - RNA, 24 nt, Artificial Sequence
  Targeting domain
uuagaucuuauucuacuccuguga

SEQ ID NO: 1335 - RNA, 23 nt, Artificial Sequence
  Targeting domain
uagaucuuauucuacuccuguga

SEQ ID NO: 1336 - RNA, 19 nt, Artificial Sequence
  Targeting domain
ucuuauucuacuccuguga

SEQ ID NO: 1337 - RNA, 24 nt, Artificial Sequence
  CEP290-527 targeting domain (RNA)
uuaucuaagauccuuucacaggag

SEQ ID NO: 1338 - RNA, 23 nt, Artificial Sequence
  CEP290-528 targeting domain (RNA)
uaucuaagauccuuucacaggag

SEQ ID NO: 1339 - RNA, 21 nt, Artificial Sequence
  CEP290-529 targeting domain (RNA)
ucuaagauccuuucacaggag

SEQ ID NO: 1340 - RNA, 19 nt, Artificial Sequence
  Targeting domain
uaagauccuuucacaggag

SEQ ID NO: 1341 - RNA, 23 nt, Artificial Sequence
  Targeting domain
uuccucaucagaaauagaggcuu

SEQ ID NO: 1342 - RNA, 22 nt, Artificial Sequence
  Targeting domain
uccucaucagaaauagaggcuu

SEQ ID NO: 1343 - RNA, 19 nt, Artificial Sequence
  Targeting domain
ucaucagaaauagaggcuu

SEQ ID NO: 1344 - RNA, 21 nt, Artificial Sequence
  Targeting domain
uuucaggauuccuacuaaauu

SEQ ID NO: 1345 - skipped

SEQ ID NO: 1346 - RNA, 19 nt, Artificial Sequence
  Targeting domain
ucaggauuccuacuaaauu

SEQ ID NO: 1347 - RNA, 24 nt, Artificial Sequence
  Targeting domain
uuguucuguccucaguaaaaggua

SEQ ID NO: 1348 - RNA, 23 nt, Artificial Sequence
  Targeting domain
uguucuguccucaguaaaaggua

SEQ ID NO: 1349 - RNA, 21 nt, Artificial Sequence
  Targeting domain
uucuguccucaguaaaaggua

SEQ ID NO: 1350 - skipped

SEQ ID NO: 1351 - RNA, 18 nt, Artificial Sequence
  Targeting domain
uguccucaguaaaaggua

SEQ ID NO: 1352 - RNA, 24 nt, Artificial Sequence
  Targeting domain
uacucagaacaacguuuucauuua

SEQ ID NO: 1353 - RNA, 21 nt, Artificial Sequence
  Targeting domain
ucagaacaacguuuucauuua

SEQ ID NO: 1354 - RNA, 23 nt, Artificial Sequence
  Targeting domain
uagaauaucauaaguuacaaucu

SEQ ID NO: 1355 - RNA, 18 nt, Artificial Sequence
  Targeting domain
uaucauaaguuacaaucu

SEQ ID NO: 1356 - RNA, 24 nt, Artificial Sequence
  Targeting domain
ucaaguggcuguaagauaacuaca

SEQ ID NO: 1357 - RNA, 19 nt, Artificial Sequence
  Targeting domain
uggcuguaagauaacuaca

SEQ ID NO: 1358 - RNA, 23 nt, Artificial Sequence
  Targeting domain
uguuuaacguuaucauuuuccca

SEQ ID NO: 1359 - RNA, 21 nt, Artificial Sequence
  Targeting domain
uuuaacguuaucauuuuccca

SEQ ID NO: 1360 - skipped

SEQ ID NO: 1361 - RNA, 19 nt, Artificial Sequence
  Targeting domain
uaacguuaucauuuuccca

SEQ ID NO: 1362 - RNA, 23 nt, Artificial Sequence
  Targeting domain
uaagagaaagggaugggcacuua

SEQ ID NO: 1363 - RNA, 22 nt, Artificial Sequence
  Targeting domain
uucaguaaaugaaaacguuguu

SEQ ID NO: 1364 - RNA, 21 nt, Artificial Sequence
  Targeting domain
ucaguaaaugaaaacguuguu

SEQ ID NO: 1365 - RNA, 22 nt, Artificial Sequence
  Targeting domain
uaaacaugacucauaauuuagu

SEQ ID NO: 1366 - RNA, 24 nt, Artificial Sequence
  Targeting domain
uauucuuaucuaagauccuuucac

SEQ ID NO: 1367 - RNA, 22 nt, Artificial Sequence
  Targeting domain
uucuuaucuaagauccuuucac

SEQ ID NO: 1368 - RNA, 21 nt, Artificial Sequence
  Targeting domain
ucuuaucuaagauccuuucac

SEQ ID NO: 1369 - RNA, 19 nt, Artificial Sequence
  Targeting domain
uuaucuaagauccuuucac

SEQ ID NO: 1370 - RNA, 18 nt, Artificial Sequence
  Targeting domain
uaucuaagauccuuucac

SEQ ID NO: 1371 - RNA, 23 nt, Artificial Sequence
  Targeting domain
ucagaaauagaggcuuauggauu

SEQ ID NO: 1372 - RNA, 23 nt, Artificial Sequence
  Targeting domain
uucuggguacagggguaagagaa

SEQ ID NO: 1373 - RNA, 22 nt, Artificial Sequence
  Targeting domain
ucuggguacagggguaagagaa

SEQ ID NO: 1374 - RNA, 20 nt, Artificial Sequence
  Targeting domain
uggguacagggguaagagaa

SEQ ID NO: 1375 - RNA, 21 nt, Artificial Sequence
  Targeting domain
uauauuaucuauuuauagugg

SEQ ID NO: 1376 - RNA, 19 nt, Artificial Sequence
  Targeting domain
uauuaucuauuuauagugg

SEQ ID NO: 1377 - RNA, 23 nt, Artificial Sequence
  Targeting domain
uaaauucucaucauuuuuuauug

SEQ ID NO: 1378 - RNA, 19 nt, Artificial Sequence
  Targeting domain
uucucaucauuuuuuauug

SEQ ID NO: 1379 - RNA, 18 nt, Artificial Sequence
  Targeting domain
ucucaucauuuuuuauug

SEQ ID NO: 1380 - RNA, 24 nt, Artificial Sequence
  Targeting domain
uagaauaaauguagaauuuuaaug

SEQ ID NO: 1381 - RNA, 19 nt, Artificial Sequence
  Targeting domain
uaaauguagaauuuuaaug

SEQ ID NO: 1382 - RNA, 24 nt, Artificial Sequence
  CEP290-572 targeting domain (RNA)
ucauuuuuuauuguagaauaaaug

SEQ ID NO: 1383 - RNA, 21 nt, Artificial Sequence
  Targeting domain
uuuuuuauuguagaauaaaug

SEQ ID NO: 1384 - RNA, 20 nt, Artificial Sequence
  Targeting domain
uuuuuauuguagaauaaaug

SEQ ID NO: 1385 - RNA, 19 nt, Artificial Sequence
  Targeting domain
uuuuauuguagaauaaaug

SEQ ID NO: 1386 - RNA, 18 nt, Artificial Sequence
  Targeting domain
uuuauuguagaauaaaug

SEQ ID NO: 1387 - RNA, 19 nt, Artificial Sequence
  Targeting domain
aaaagcuaccgguuaccug

SEQ ID NO: 1388 - RNA, 18 nt, Artificial Sequence
  Targeting domain
aaagcuaccgguuaccug

SEQ ID NO: 1389 - RNA, 24 nt, Artificial Sequence
  Targeting domain
aguuuuuaaggcggggagucacau

SEQ ID NO: 1390 - RNA, 19 nt, Artificial Sequence
  Targeting domain
acauccuccuuacugccac

SEQ ID NO: 1391 - RNA, 23 nt, Artificial Sequence
  CEP290-581 targeting domain (RNA)
agucacaggguaggauucauguu

SEQ ID NO: 1392 - RNA, 19 nt, Artificial Sequence
  Targeting domain
acaggguaggauucauguu

SEQ ID NO: 1393 - RNA, 21 nt, Artificial Sequence
  Targeting domain
acagaguucaagcuaauacau

SEQ ID NO: 1394 - RNA, 19 nt, Artificial Sequence
  Targeting domain
agaguucaagcuaauacau

SEQ ID NO: 1395 - RNA, 24 nt, Artificial Sequence
  CEP290-585 targeting domain (RNA)
auaagaugcagaacuaguguagac

SEQ ID NO: 1396 - RNA, 22 nt, Artificial Sequence
  Targeting domain
aagaugcagaacuaguguagac

SEQ ID NO: 1397 - RNA, 21 nt, Artificial Sequence
  Targeting domain
agaugcagaacuaguguagac

SEQ ID NO: 1398 - RNA, 19 nt, Artificial Sequence
  Targeting domain
augcagaacuaguguagac

SEQ ID NO: 1399 - RNA, 18 nt, Artificial Sequence
  Targeting domain
aguaucuccuguuuggca

SEQ ID NO: 1400 - RNA, 23 nt, Artificial Sequence
  CEP290-590 targeting domain (RNA)
acgaaaaucagauuucaugugug

SEQ ID NO: 1401 - RNA, 20 nt, Artificial Sequence
  Targeting domain
aaaaucagauuucaugugug

SEQ ID NO: 1402 - RNA, 19 nt, Artificial Sequence
  Targeting domain
aaaucagauuucaugugug

SEQ ID NO: 1403 - RNA, 18 nt, Artificial Sequence
  Targeting domain
aaucagauuucaugugug

SEQ ID NO: 1404 - RNA, 21 nt, Artificial Sequence
  CEP290-594 targeting domain (RNA)
acaagaaugaucauucuaaac

SEQ ID NO: 1405 - RNA, 19 nt, Artificial Sequence
  Targeting domain
aagaaugaucauucuaaac

SEQ ID NO: 1406 - RNA, 18 nt, Artificial Sequence
  Targeting domain
agaaugaucauucuaaac

SEQ ID NO: 1407 - RNA, 24 nt, Artificial Sequence
  Targeting domain
aggcggggagucacaugggaguca

SEQ ID NO: 1408 - RNA, 23 nt, Artificial Sequence
  Targeting domain
agcuuuugacaguuuuuaaggcg

SEQ ID NO: 1409 - RNA, 24 nt, Artificial Sequence
  Targeting domain
aaugaucauucuuguggcaguaag

SEQ ID NO: 1410 - RNA, 23 nt, Artificial Sequence
  Targeting domain
augaucauucuuguggcaguaag

SEQ ID NO: 1411 - skipped

SEQ ID NO: 1412 - RNA, 23 nt, Artificial Sequence
  Targeting domain
aucuagagcaagagaugaacuag

SEQ ID NO: 1413 - RNA, 19 nt, Artificial Sequence
  Targeting domain
agagcaagagaugaacuag

SEQ ID NO: 1414 - RNA, 23 nt, Artificial Sequence
  Targeting domain
aaugccugaacaaguuuugaaac

SEQ ID NO: 1415 - RNA, 22 nt, Artificial Sequence
  Targeting domain
augccugaacaaguuuugaaac

SEQ ID NO: 1416 - RNA, 21 nt, Artificial Sequence
  Targeting domain
agauugagguagaaucaagaa

SEQ ID NO: 1417 - RNA, 19 nt, Artificial Sequence
  Targeting domain
auugagguagaaucaagaa

SEQ ID NO: 1418 - RNA, 22 nt, Artificial Sequence
  Targeting domain
auguaagacuggagauagagac

SEQ ID NO: 1419 - RNA, 18 nt, Artificial Sequence
  Targeting domain
aagacuggagauagagac

SEQ ID NO: 1420 - RNA, 21 nt, Artificial Sequence
  Targeting domain
agucacaugggagucacaggg

SEQ ID NO: 1421 - RNA, 19 nt, Artificial Sequence
  Targeting domain
acauaucugucuuccuuaa

SEQ ID NO: 1422 - RNA, 24 nt, Artificial Sequence
  Targeting domain
aaaucagauuucaugugugaagaa

SEQ ID NO: 1423 - RNA, 23 nt, Artificial Sequence
  Targeting domain
aaucagauuucaugugugaagaa

SEQ ID NO: 1424 - RNA, 22 nt, Artificial Sequence
  Targeting domain
aucagauuucaugugugaagaa

SEQ ID NO: 1425 - RNA, 19 nt, Artificial Sequence
  Targeting domain
agauuucaugugugaagaa

SEQ ID NO: 1426-1430 - skipped (5 entries)

SEQ ID NO: 1431 - RNA, 24 nt, Artificial Sequence
  Targeting domain
aacuauuuaauuuguuucugugug

SEQ ID NO: 1432 - RNA, 23 nt, Artificial Sequence
  Targeting domain
acuauuuaauuuguuucugugug

SEQ ID NO: 1433 - skipped

SEQ ID NO: 1434 - RNA, 24 nt, Artificial Sequence
  Targeting domain
cugucaaaagcuaccgguuaccug

SEQ ID NO: 1435 - skipped

SEQ ID NO: 1436 - RNA, 22 nt, Artificial Sequence
  CEP290-627 targeting domain (RNA)
cuuacauccuccuuacugccac

SEQ ID NO: 1437 - RNA, 18 nt, Artificial Sequence
  CEP290-628 targeting domain (RNA)
cauccuccuuacugccac

SEQ ID NO: 1438 - skipped

SEQ ID NO: 1439 - RNA, 18 nt, Artificial Sequence
  Targeting domain
caggguaggauucauguu

SEQ ID NO: 1440 - RNA, 22 nt, Artificial Sequence
  Targeting domain
cacagaguucaagcuaauacau

SEQ ID NO: 1441 - skipped

SEQ ID NO: 1442 - RNA, 24 nt, Artificial Sequence
  CEP290-633 targeting domain (RNA)
cacgaaaaucagauuucaugugug

SEQ ID NO: 1443 - RNA, 22 nt, Artificial Sequence
  Targeting domain
cgaaaaucagauuucaugugug

SEQ ID NO: 1444 - RNA, 23 nt, Artificial Sequence
  Targeting domain
ccacaagaaugaucauucuaaac

SEQ ID NO: 1445 - RNA, 22 nt, Artificial Sequence
  Targeting domain
cacaagaaugaucauucuaaac

SEQ ID NO: 1446 - skipped

SEQ ID NO: 1447 - RNA, 21 nt, Artificial Sequence
  Targeting domain
cggggagucacaugggaguca

SEQ ID NO: 1448 - RNA, 21 nt, Artificial Sequence
  Targeting domain
cuuuugacaguuuuuaaggcg

SEQ ID NO: 1449 - RNA, 18 nt, Artificial Sequence
  Targeting domain
cauucuuguggcaguaag

SEQ ID NO: 1450 - RNA, 24 nt, Artificial Sequence
  CEP290-641 targeting domain (RNA)
caucuagagcaagagaugaacuag

SEQ ID NO: 1451 - RNA, 21 nt, Artificial Sequence
  CEP290-642 targeting domain (RNA)
cuagagcaagagaugaacuag

SEQ ID NO: 1452 - RNA, 19 nt, Artificial Sequence
  CEP290-643 targeting domain (RNA)
ccugaacaaguuuugaaac

SEQ ID NO: 1453 - RNA, 18 nt, Artificial Sequence
  CEP290-644 targeting domain (RNA)
cugaacaaguuuugaaac

SEQ ID NO: 1454 - RNA, 23 nt, Artificial Sequence
  CEP290-645 targeting domain (RNA)
cucucuuccaguuguuuugcuca

SEQ ID NO: 1455 - RNA, 21 nt, Artificial Sequence
  Targeting domain
cucuuccaguuguuuugcuca

SEQ ID NO: 1456 - RNA, 19 nt, Artificial Sequence
  Targeting domain
cuuccaguuguuuugcuca

SEQ ID NO: 1457 - RNA, 18 nt, Artificial Sequence
  Targeting domain
cacaugggagucacaggg

SEQ ID NO: 1458 - RNA, 18 nt, Artificial Sequence
  Targeting domain
cauaucugucuuccuuaa

SEQ ID NO: 1459 - skipped

SEQ ID NO: 1460 - RNA, 22 nt, Artificial Sequence
  CEP290-651 targeting domain (RNA)
cuauuuaauuuguuucugugug

SEQ ID NO: 1461 - RNA, 23 nt, Artificial Sequence
  CEP290-652 targeting domain (RNA)
ugucaaaagcuaccgguuaccug

SEQ ID NO: 1462 - RNA, 21 nt, Artificial Sequence
  CEP290-653 targeting domain (RNA)
ucaaaagcuaccgguuaccug

SEQ ID NO: 1463 - RNA, 22 nt, Artificial Sequence
  Targeting domain
uuuuuaaggcggggagucacau

SEQ ID NO: 1464 - RNA, 21 nt, Artificial Sequence
  Targeting domain
uuuuaaggcggggagucacau

SEQ ID NO: 1465 - skipped

SEQ ID NO: 1466 - RNA, 19 nt, Artificial Sequence
  Targeting domain
uuaaggcggggagucacau

SEQ ID NO: 1467 - RNA, 18 nt, Artificial Sequence
  Targeting domain
uaaggcggggagucacau

SEQ ID NO: 1468 - RNA, 23 nt, Artificial Sequence
  CEP290-659 targeting domain (RNA)
ucuuacauccuccuuacugccac

SEQ ID NO: 1469 - RNA, 21 nt, Artificial Sequence
  Targeting domain
uuacauccuccuuacugccac

SEQ ID NO: 1470 - skipped

SEQ ID NO: 1471 - RNA, 21 nt, Artificial Sequence
  CEP290-662 targeting domain (RNA)
ucacaggguaggauucauguu

SEQ ID NO: 1472 - RNA, 23 nt, Artificial Sequence
  CEP290-663 targeting domain (RNA)
uaagaugcagaacuaguguagac

SEQ ID NO: 1473 - RNA, 18 nt, Artificial Sequence
  CEP290-664 targeting domain (RNA)
ugcagaacuaguguagac

SEQ ID NO: 1474 - RNA, 23 nt, Artificial Sequence
  CEP290-665 targeting domain (RNA)
uguugaguaucuccuguuuggca

SEQ ID NO: 1475 - RNA, 21 nt, Artificial Sequence
  CEP290-666 targeting domain (RNA)
uugaguaucuccuguuuggca

SEQ ID NO: 1476 - skipped

SEQ ID NO: 1477 - RNA, 24 nt, Artificial Sequence
  CEP290-668 targeting domain (RNA)
uagcuuuugacaguuuuuaaggcg

SEQ ID NO: 1478 - skipped

SEQ ID NO: 1479 - RNA, 19 nt, Artificial Sequence
  CEP290-670 targeting domain (RNA)
uuugacaguuuuuaaggcg

SEQ ID NO: 1480 - RNA, 18 nt, Artificial Sequence
  CEP290-671 targeting domain (RNA)
uugacaguuuuuaaggcg

SEQ ID NO: 1481 - RNA, 22 nt, Artificial Sequence
  CEP290-672 targeting domain (RNA)
ugaucauucuuguggcaguaag

SEQ ID NO: 1482 - RNA, 19 nt, Artificial Sequence
  CEP290-673 targeting domain (RNA)
ucauucuuguggcaguaag

SEQ ID NO: 1483 - RNA, 22 nt, Artificial Sequence
  CEP290-674 targeting domain (RNA)
ucuagagcaagagaugaacuag

SEQ ID NO: 1484 - skipped

SEQ ID NO: 1485 - RNA, 24 nt, Artificial Sequence
  CEP290-676 targeting domain (RNA)
uaaugccugaacaaguuuugaaac

SEQ ID NO: 1486 - RNA, 21 nt, Artificial Sequence
  CEP290-677 targeting domain (RNA)
ugccugaacaaguuuugaaac

SEQ ID NO: 1487 - RNA, 24 nt, Artificial Sequence
  CEP290-678 targeting domain (RNA)
uguagauugagguagaaucaagaa

SEQ ID NO: 1488 - RNA, 22 nt, Artificial Sequence
  CEP290-679 targeting domain (RNA)
uagauugagguagaaucaagaa

SEQ ID NO: 1489 - RNA, 18 nt, Artificial Sequence
  CEP290-680 targeting domain (RNA)
uugagguagaaucaagaa

SEQ ID NO: 1490 - RNA, 21 nt, Artificial Sequence
  CEP290-681 targeting domain (RNA)
uguaagacuggagauagagac

SEQ ID NO: 1491 - RNA, 19 nt, Artificial Sequence
  CEP290-682 targeting domain (RNA)
uaagacuggagauagagac

SEQ ID NO: 1492 - RNA, 24 nt, Artificial Sequence
  CEP290-683 targeting domain (RNA)
ucucucuuccaguuguuuugcuca

SEQ ID NO: 1493 - RNA, 22 nt, Artificial Sequence
  CEP290-684 targeting domain (RNA)
ucucuuccaguuguuuugcuca

SEQ ID NO: 1494 - skipped

SEQ ID NO: 1495 - RNA, 18 nt, Artificial Sequence
  CEP290-686 targeting domain (RNA)
uuccaguuguuuugcuca

SEQ ID NO: 1496 - RNA, 19 nt, Artificial Sequence
  CEP290-687 targeting domain (RNA)
ucacaugggagucacaggg

SEQ ID NO: 1497 - RNA, 24 nt, Artificial Sequence
  CEP290-688 targeting domain (RNA)
uguuuacauaucugucuuccuuaa

SEQ ID NO: 1498 - RNA, 22 nt, Artificial Sequence
  CEP290-689 targeting domain (RNA)
uuuacauaucugucuuccuuaa

SEQ ID NO: 1499 - RNA, 21 nt, Artificial Sequence
  CEP290-690 targeting domain (RNA)
uuacauaucugucuuccuuaa

SEQ ID NO: 1500 - skipped

SEQ ID NO: 1501 - RNA, 21 nt, Artificial Sequence
  Targeting domain
ucagauuucaugugugaagaa

SEQ ID NO: 1502 - skipped

SEQ ID NO: 1503 - RNA, 21 nt, Artificial Sequence
  CEP290-694 targeting domain (RNA)
uauuuaauuuguuucugugug

SEQ ID NO: 1504 - RNA, 19 nt, Artificial Sequence
  CEP290-695 targeting domain (RNA)
uuuaauuuguuucugugug

SEQ ID NO: 1505 - RNA, 18 nt, Artificial Sequence
  CEP290-696 targeting domain (RNA)
uuaauuuguuucugugug

SEQ ID NO: 1506 - RNA, 21 nt, Artificial Sequence
  CEP290-697 targeting domain (RNA)
guagaauaaauuuauuuaaug

SEQ ID NO: 1507 - RNA, 18 nt, Artificial Sequence
  CEP290-495 targeting domain (RNA)
gaauaaauuuauuuaaug

SEQ ID NO: 1508 - RNA, 23 nt, Artificial Sequence
  CEP290-698 targeting domain (RNA)
gagaaaaaggagcaugaaacagg

SEQ ID NO: 1509 - RNA, 21 nt, Artificial Sequence
  CEP290-699 targeting domain (RNA)
gaaaaaggagcaugaaacagg

SEQ ID NO: 1510 - RNA, 22 nt, Artificial Sequence
  CEP290-700 targeting domain (RNA)
guagaauaaaaaauaaaaaaac

SEQ ID NO: 1511 - RNA, 19 nt, Artificial Sequence
  CEP290-701 targeting domain (RNA)
gaauaaaaaauaaaaaaac

SEQ ID NO: 1512 - RNA, 24 nt, Artificial Sequence
  CEP290-702 targeting domain (RNA)
gaauaaaaaauaaaaaaacuagag

SEQ ID NO: 1513 - RNA, 20 nt, Artificial Sequence
  CEP290-508 targeting domain (RNA)
gaaauagauguagauugagg

SEQ ID NO: 1514 - RNA, 21 nt, Artificial Sequence
  CEP290-703 targeting domain (RNA)
gauaauaaggaaauacaaaaa

SEQ ID NO: 1515 - RNA, 23 nt, Artificial Sequence
  CEP290-704 targeting domain (RNA)
guguugcccaggcuggagugcag

SEQ ID NO: 1516 - RNA, 21 nt, Artificial Sequence
  CEP290-705 targeting domain (RNA)
guugcccaggcuggagugcag

SEQ ID NO: 1517 - RNA, 18 nt, Artificial Sequence
  CEP290-706 targeting domain (RNA)
gcccaggcuggagugcag

SEQ ID NO: 1518 - RNA, 19 nt, Artificial Sequence
  CEP290-707 targeting domain (RNA)
guuguuuuuuuuuuugaaa

SEQ ID NO: 1519 - RNA, 23 nt, Artificial Sequence
  CEP290-708 targeting domain (RNA)
gagucucacuguguugcccaggc

SEQ ID NO: 1520 - RNA, 21 nt, Artificial Sequence
  CEP290-709 targeting domain (RNA)
gucucacuguguugcccaggc

SEQ ID NO: 1521 - RNA, 24 nt, Artificial Sequence
  CEP290-710 targeting domain (RNA)
aauguagaauaaauuuauuuaaug

SEQ ID NO: 1522 - RNA, 23 nt, Artificial Sequence
  CEP290-711 targeting domain (RNA)
auguagaauaaauuuauuuaaug

SEQ ID NO: 1523 - RNA, 19 nt, Artificial Sequence
  CEP290-712 targeting domain (RNA)
agaauaaauuuauuuaaug

SEQ ID NO: 1524 - RNA, 24 nt, Artificial Sequence
  CEP290-713 targeting domain (RNA)
auuuauucuacaauaaaaaaugau

SEQ ID NO: 1525 - RNA, 20 nt, Artificial Sequence
  Targeting domain
auucuacaauaaaaaaugau

SEQ ID NO: 1526 - RNA, 24 nt, Artificial Sequence
  CEP290-715 targeting domain (RNA)
agagaaaaaggagcaugaaacagg

SEQ ID NO: 1527 - RNA, 22 nt, Artificial Sequence
  CEP290-716 targeting domain (RNA)
agaaaaaggagcaugaaacagg

SEQ ID NO: 1528 - RNA, 20 nt, Artificial Sequence
  Targeting domain
aaaaaggagcaugaaacagg

SEQ ID NO: 1529 - RNA, 19 nt, Artificial Sequence
  Targeting domain
aaaaggagcaugaaacagg

SEQ ID NO: 1530 - RNA, 18 nt, Artificial Sequence
  Targeting domain
aaaggagcaugaaacagg

SEQ ID NO: 1531 - RNA, 24 nt, Artificial Sequence
  CEP290-720 targeting domain (RNA)
acaauaaaaaaugaugagaauuua

SEQ ID NO: 1532 - RNA, 22 nt, Artificial Sequence
  Targeting domain
aauaaaaaaugaugagaauuua

SEQ ID NO: 1533 - RNA, 21 nt, Artificial Sequence
  Targeting domain
auaaaaaaugaugagaauuua

SEQ ID NO: 1534 - RNA, 19 nt, Artificial Sequence
  Targeting domain
aaaaaaugaugagaauuua

SEQ ID NO: 1535 - RNA, 18 nt, Artificial Sequence
  Targeting domain
aaaaaugaugagaauuua

SEQ ID NO: 1536 - RNA, 24 nt, Artificial Sequence
  Targeting domain
auguagaauaaaaaauaaaaaaac

SEQ ID NO: 1537 - RNA, 20 nt, Artificial Sequence
  Targeting domain
agaauaaaaaauaaaaaaac

SEQ ID NO: 1538 - RNA, 18 nt, Artificial Sequence
  Targeting domain
aauaaaaaauaaaaaaac

SEQ ID NO: 1539 - RNA, 23 nt, Artificial Sequence
  CEP290-728 targeting domain (RNA)
aauaaaaaauaaaaaaacuagag

SEQ ID NO: 1540 - RNA, 22 nt, Artificial Sequence
  Targeting domain
auaaaaaauaaaaaaacuagag

SEQ ID NO: 1541 - RNA, 20 nt, Artificial Sequence
  Targeting domain
aaaaaauaaaaaaacuagag

SEQ ID NO: 1542 - RNA, 19 nt, Artificial Sequence
  Targeting domain
aaaaauaaaaaaacuagag

SEQ ID NO: 1543 - RNA, 18 nt, Artificial Sequence
  Targeting domain
aaaauaaaaaaacuagag

SEQ ID NO: 1544 - RNA, 23 nt, Artificial Sequence
  Targeting domain
caauaaaaaaugaugagaauuua

SEQ ID NO: 1545 - RNA, 22 nt, Artificial Sequence
  Targeting domain
uguagaauaaauuuauuuaaug

SEQ ID NO: 1546 - RNA, 20 nt, Artificial Sequence
  Targeting domain
uagaauaaauuuauuuaaug

SEQ ID NO: 1547 - RNA, 23 nt, Artificial Sequence
  Targeting domain
uuuauucuacaauaaaaaaugau

SEQ ID NO: 1548 - RNA, 22 nt, Artificial Sequence
  Targeting domain
uuauucuacaauaaaaaaugau

SEQ ID NO: 1549 - RNA, 21 nt, Artificial Sequence
  Targeting domain
uauucuacaauaaaaaaugau

SEQ ID NO: 1550 - RNA, 19 nt, Artificial Sequence
  Targeting domain
uucuacaauaaaaaaugau

SEQ ID NO: 1551 - RNA, 18 nt, Artificial Sequence
  Targeting domain
ucuacaauaaaaaaugau

SEQ ID NO: 1552 - RNA, 20 nt, Artificial Sequence
  Targeting domain
uaaaaaaugaugagaauuua

SEQ ID NO: 1553 - RNA, 23 nt, Artificial Sequence
  Targeting domain
uguagaauaaaaaauaaaaaaac

SEQ ID NO: 1554 - RNA, 21 nt, Artificial Sequence
  Targeting domain
uagaauaaaaaauaaaaaaac

SEQ ID NO: 1555 - RNA, 21 nt, Artificial Sequence
  Targeting domain
uaaaaaauaaaaaaacuagag

SEQ ID NO: 1556 - RNA, 24 nt, Artificial Sequence
  Targeting domain
aaaagaaauagauguagauugagg

SEQ ID NO: 1557 - RNA, 23 nt, Artificial Sequence
  Targeting domain
aaagaaauagauguagauugagg

SEQ ID NO: 1558 - RNA, 22 nt, Artificial Sequence
  Targeting domain
aagaaauagauguagauugagg

SEQ ID NO: 1559 - RNA, 21 nt, Artificial Sequence
  Targeting domain
agaaauagauguagauugagg

SEQ ID NO: 1560 - RNA, 19 nt, Artificial Sequence
  Targeting domain
aaauagauguagauugagg

SEQ ID NO: 1561 - RNA, 18 nt, Artificial Sequence
  Targeting domain
aauagauguagauugagg

SEQ ID NO: 1562 - RNA, 24 nt, Artificial Sequence
  Targeting domain
auaauaaggaaauacaaaaacugg

SEQ ID NO: 1563 - RNA, 22 nt, Artificial Sequence
  Targeting domain
aauaaggaaauacaaaaacugg

SEQ ID NO: 1564 - RNA, 21 nt, Artificial Sequence
  Targeting domain
auaaggaaauacaaaaacugg

SEQ ID NO: 1565 - RNA, 19 nt, Artificial Sequence
  Targeting domain
aaggaaauacaaaaacugg

SEQ ID NO: 1566 - RNA, 18 nt, Artificial Sequence
  Targeting domain
aggaaauacaaaaacugg

SEQ ID NO: 1567 - RNA, 24 nt, Artificial Sequence
  Targeting domain
auagauaauaaggaaauacaaaaa

SEQ ID NO: 1568 - RNA, 22 nt, Artificial Sequence
  Targeting domain
agauaauaaggaaauacaaaaa

SEQ ID NO: 1569 - RNA, 20 nt, Artificial Sequence
  Targeting domain
auaauaaggaaauacaaaaa

SEQ ID NO: 1570 - RNA, 18 nt, Artificial Sequence
  Targeting domain
aauaaggaaauacaaaaa

SEQ ID NO: 1571 - RNA, 20 nt, Artificial Sequence
  Targeting domain
aaaaaaaaaaacaacaaaaa

SEQ ID NO: 1572 - RNA, 19 nt, Artificial Sequence
  Targeting domain
aaaaaaaaaacaacaaaaa

SEQ ID NO: 1573 - RNA, 18 nt, Artificial Sequence
  Targeting domain
aaaaaaaaacaacaaaaa

SEQ ID NO: 1574 - RNA, 24 nt, Artificial Sequence
  Targeting domain
agagucucacuguguugcccaggc

SEQ ID NO: 1575 - RNA, 22 nt, Artificial Sequence
  Targeting domain
agucucacuguguugcccaggc

SEQ ID NO: 1576 - RNA, 21 nt, Artificial Sequence
  Targeting domain
caaaaaaaaaaacaacaaaaa

SEQ ID NO: 1577 - RNA, 19 nt, Artificial Sequence
  Targeting domain
cucacuguguugcccaggc

SEQ ID NO: 1578 - RNA, 23 nt, Artificial Sequence
  Targeting domain
uaauaaggaaauacaaaaacugg

SEQ ID NO: 1579 - RNA, 20 nt, Artificial Sequence
  Targeting domain
uaaggaaauacaaaaacugg

SEQ ID NO: 1580 - RNA, 23 nt, Artificial Sequence
  CEP290-769 targeting domain (RNA)
uagauaauaaggaaauacaaaaa

SEQ ID NO: 1581 - RNA, 19 nt, Artificial Sequence
  Targeting domain
uaauaaggaaauacaaaaa

SEQ ID NO: 1582 - RNA, 24 nt, Artificial Sequence
  Targeting domain
uguguugcccaggcuggagugcag

SEQ ID NO: 1583 - RNA, 22 nt, Artificial Sequence
  CEP290-772 targeting domain (RNA)
uguugcccaggcuggagugcag

SEQ ID NO: 1584 - skipped

SEQ ID NO: 1585 - RNA, 19 nt, Artificial Sequence
  Targeting domain
ugcccaggcuggagugcag

SEQ ID NO: 1586 - RNA, 24 nt, Artificial Sequence
  Targeting domain
uuucaaaaaaaaaaacaacaaaaa

SEQ ID NO: 1587 - RNA, 23 nt, Artificial Sequence
  Targeting domain
uucaaaaaaaaaaacaacaaaaa

SEQ ID NO: 1588 - RNA, 22 nt, Artificial Sequence
  Targeting domain
ucaaaaaaaaaaacaacaaaaa

SEQ ID NO: 1589 - RNA, 24 nt, Artificial Sequence
  Targeting domain
uuuuuguuguuuuuuuuuuugaaa

SEQ ID NO: 1590 - RNA, 23 nt, Artificial Sequence
  Targeting domain
uuuuguuguuuuuuuuuuugaaa

SEQ ID NO: 1591 - RNA, 22 nt, Artificial Sequence
  Targeting domain
uuuguuguuuuuuuuuuugaaa

SEQ ID NO: 1592 - RNA, 21 nt, Artificial Sequence
  Targeting domain
uuguuguuuuuuuuuuugaaa

SEQ ID NO: 1593 - RNA, 20 nt, Artificial Sequence
  Targeting domain
uguuguuuuuuuuuuugaaa

SEQ ID NO: 1594 - RNA, 18 nt, Artificial Sequence
  Targeting domain
uuguuuuuuuuuuugaaa

SEQ ID NO: 1595 - skipped

SEQ ID NO: 1596 - RNA, 18 nt, Artificial Sequence
  CEP290-785 targeting domain (RNA)
ucacuguguugcccaggc

SEQ ID NO: 1597 - RNA, 21 nt, Artificial Sequence
  CEP290-786 targeting domain (RNA)
acuguuggcuacauccauucc

SEQ ID NO: 1598 - RNA, 24 nt, Artificial Sequence
  CEP290-787 targeting domain (RNA)
aauuuacagagugcauccaugguc

SEQ ID NO: 1599 - RNA, 23 nt, Artificial Sequence
  CEP290-788 targeting domain (RNA)
auuuacagagugcauccaugguc

SEQ ID NO: 1600 - RNA, 19 nt, Artificial Sequence
  CEP290-789 targeting domain (RNA)
acagagugcauccaugguc

SEQ ID NO: 1601 - skipped

SEQ ID NO: 1602 - RNA, 21 nt, Artificial Sequence
  Targeting domain
auggucccuggcuuuuguucc

SEQ ID NO: 1603 - RNA, 19 nt, Artificial Sequence
  Targeting domain
auagagacacauucaguaa

SEQ ID NO: 1604 - RNA, 24 nt, Artificial Sequence
  Targeting domain
agcucaaaagcuuuugcuggcuca

SEQ ID NO: 1605 - RNA, 19 nt, Artificial Sequence
  Targeting domain
aaaagcuuuugcuggcuca

SEQ ID NO: 1606 - RNA, 18 nt, Artificial Sequence
  Targeting domain
aaagcuuuugcuggcuca

SEQ ID NO: 1607 - RNA, 24 nt, Artificial Sequence
  Targeting domain
aauccauaagccucuauuucugau

SEQ ID NO: 1608 - RNA, 23 nt, Artificial Sequence
  Targeting domain
auccauaagccucuauuucugau

SEQ ID NO: 1609 - RNA, 19 nt, Artificial Sequence
  Targeting domain
auaagccucuauuucugau

SEQ ID NO: 1610 - RNA, 23 nt, Artificial Sequence
  Targeting domain
agcuaaaucaugcaagugaccua

SEQ ID NO: 1611 - RNA, 19 nt, Artificial Sequence
  Targeting domain
aaaucaugcaagugaccua

SEQ ID NO: 1612 - RNA, 18 nt, Artificial Sequence
  Targeting domain
aaucaugcaagugaccua

SEQ ID NO: 1613 - RNA, 23 nt, Artificial Sequence
  Targeting domain
aaaccucuuuuaaccagacaucu

SEQ ID NO: 1614 - RNA, 22 nt, Artificial Sequence
  Targeting domain
aaccucuuuuaaccagacaucu

SEQ ID NO: 1615 - RNA, 21 nt, Artificial Sequence
  Targeting domain
accucuuuuaaccagacaucu

SEQ ID NO: 1616 - RNA, 24 nt, Artificial Sequence
  Targeting domain
aguuuguucuggguacagggguaa

SEQ ID NO: 1617 - RNA, 24 nt, Artificial Sequence
  Targeting domain
augacucauaauuuaguaggaauc

SEQ ID NO: 1618 - RNA, 21 nt, Artificial Sequence
  Targeting domain
acucauaauuuaguaggaauc

SEQ ID NO: 1619 - RNA, 21 nt, Artificial Sequence
  Targeting domain
aauggauguagccaacaguag

SEQ ID NO: 1620 - RNA, 20 nt, Artificial Sequence
  Targeting domain
auggauguagccaacaguag

SEQ ID NO: 1621 - RNA, 24 nt, Artificial Sequence
  Targeting domain
aucaccucucuuuggcaaaagcag

SEQ ID NO: 1622 - RNA, 21 nt, Artificial Sequence
  Targeting domain
accucucuuuggcaaaagcag

SEQ ID NO: 1623 - RNA, 23 nt, Artificial Sequence
  Targeting domain
agguagaauauuguaaucaaagg

SEQ ID NO: 1624 - RNA, 19 nt, Artificial Sequence
  Targeting domain
agaauauuguaaucaaagg

SEQ ID NO: 1625 - RNA, 21 nt, Artificial Sequence
  Targeting domain
aaggaacaaaagccagggacc

SEQ ID NO: 1626 - RNA, 20 nt, Artificial Sequence
  Targeting domain
aggaacaaaagccagggacc

SEQ ID NO: 1627 - RNA, 24 nt, Artificial Sequence
  Targeting domain
acauccauuccaaggaacaaaagc

SEQ ID NO: 1628 - RNA, 22 nt, Artificial Sequence
  Targeting domain
auccauuccaaggaacaaaagc

SEQ ID NO: 1629 - RNA, 18 nt, Artificial Sequence
  Targeting domain
auuccaaggaacaaaagc

SEQ ID NO: 1630 - RNA, 24 nt, Artificial Sequence
  Targeting domain
agaauuagaucuuauucuacuccu

SEQ ID NO: 1631 - RNA, 22 nt, Artificial Sequence
  Targeting domain
aauuagaucuuauucuacuccu

SEQ ID NO: 1632 - RNA, 21 nt, Artificial Sequence
  Targeting domain
auuagaucuuauucuacuccu

SEQ ID NO: 1633 - RNA, 18 nt, Artificial Sequence
  Targeting domain
agaucuuauucuacuccu

SEQ ID NO: 1634 - RNA, 19 nt, Artificial Sequence
  Targeting domain
auuuguucaucuuccucau

SEQ ID NO: 1635 - RNA, 23 nt, Artificial Sequence
  Targeting domain
agaggugauuauguuacuuuuua

SEQ ID NO: 1636 - RNA, 21 nt, Artificial Sequence
  Targeting domain
aggugauuauguuacuuuuua

SEQ ID NO: 1637 - RNA, 24 nt, Artificial Sequence
  Targeting domain
aaccucuuuuaaccagacaucuaa

SEQ ID NO: 1638 - RNA, 23 nt, Artificial Sequence
  Targeting domain
accucuuuuaaccagacaucuaa

SEQ ID NO: 1639 - RNA, 22 nt, Artificial Sequence
  Targeting domain
auaaacaugacucauaauuuag

SEQ ID NO: 1640 - skipped

SEQ ID NO: 1641 - RNA, 19 nt, Artificial Sequence
  Targeting domain
aacaugacucauaauuuag

SEQ ID NO: 1642 - RNA, 18 nt, Artificial Sequence
  Targeting domain
acaugacucauaauuuag

SEQ ID NO: 1643 - RNA, 24 nt, Artificial Sequence
  Targeting domain
acagguagaauauuguaaucaaag

SEQ ID NO: 1644 - RNA, 22 nt, Artificial Sequence
  Targeting domain
agguagaauauuguaaucaaag

SEQ ID NO: 1645 - RNA, 18 nt, Artificial Sequence
  Targeting domain
agaauauuguaaucaaag

SEQ ID NO: 1646 - RNA, 24 nt, Artificial Sequence
  Targeting domain
auaguuuguucuggguacaggggu

SEQ ID NO: 1647 - RNA, 22 nt, Artificial Sequence
  Targeting domain
aguuuguucuggguacaggggu

SEQ ID NO: 1648 - RNA, 23 nt, Artificial Sequence
  Targeting domain
agacaucuaagagaaaaaggagc

SEQ ID NO: 1649 - RNA, 21 nt, Artificial Sequence
  Targeting domain
acaucuaagagaaaaaggagc

SEQ ID NO: 1650 - RNA, 19 nt, Artificial Sequence
  Targeting domain
aucuaagagaaaaaggagc

SEQ ID NO: 1651 - skipped

SEQ ID NO: 1652 - RNA, 18 nt, Artificial Sequence
  Targeting domain
aggauaggacagaggaca

SEQ ID NO: 1653 - RNA, 22 nt, Artificial Sequence
  Targeting domain
aggaaagaugaaaaauacucuu

SEQ ID NO: 1654 - RNA, 19 nt, Artificial Sequence
  Targeting domain
aaagaugaaaaauacucuu

SEQ ID NO: 1655 - RNA, 18 nt, Artificial Sequence
  Targeting domain
aagaugaaaaauacucuu

SEQ ID NO: 1656 - RNA, 23 nt, Artificial Sequence
  Targeting domain
aggaaagaugaaaaauacucuuu

SEQ ID NO: 1657 - skipped

SEQ ID NO: 1658 - RNA, 19 nt, Artificial Sequence
  Targeting domain
aagaugaaaaauacucuuu

SEQ ID NO: 1659 - RNA, 18 nt, Artificial Sequence
  Targeting domain
agaugaaaaauacucuuu

SEQ ID NO: 1660 - RNA, 21 nt, Artificial Sequence
  Targeting domain
aggaaagaugaaaaauacucu

SEQ ID NO: 1661 - RNA, 18 nt, Artificial Sequence
  Targeting domain
aaagaugaaaaauacucu

SEQ ID NO: 1662 - RNA, 22 nt, Artificial Sequence
  Targeting domain
auaggacagaggacauggagaa

SEQ ID NO: 1663 - skipped

SEQ ID NO: 1664 - RNA, 24 nt, Artificial Sequence
  Targeting domain
aggauaggacagaggacauggaga

SEQ ID NO: 1665 - RNA, 21 nt, Artificial Sequence
  Targeting domain
auaggacagaggacauggaga

SEQ ID NO: 1666 - RNA, 19 nt, Artificial Sequence
  Targeting domain
aggacagaggacauggaga

SEQ ID NO: 1667 - RNA, 23 nt, Artificial Sequence
  Targeting domain
aaggaacaaaagccagggaccau

SEQ ID NO: 1668 - RNA, 22 nt, Artificial Sequence
  Targeting domain
aggaacaaaagccagggaccau

SEQ ID NO: 1669 - RNA, 19 nt, Artificial Sequence
  Targeting domain
aacaaaagccagggaccau

SEQ ID NO: 1670 - RNA, 18 nt, Artificial Sequence
  Targeting domain
acaaaagccagggaccau

SEQ ID NO: 1671 - RNA, 24 nt, Artificial Sequence
  Targeting domain
acauuuauucuacaauaaaaaaug

SEQ ID NO: 1672 - RNA, 22 nt, Artificial Sequence
  Targeting domain
auuuauucuacaauaaaaaaug

SEQ ID NO: 1673 - RNA, 18 nt, Artificial Sequence
  Targeting domain
auucuacaauaaaaaaug

SEQ ID NO: 1674 - RNA, 24 nt, Artificial Sequence
  Targeting domain
auuguguguguguguguguguuau

SEQ ID NO: 1675 - RNA, 23 nt, Artificial Sequence
  Targeting domain
cuacuguuggcuacauccauucc

SEQ ID NO: 1676 - RNA, 20 nt, Artificial Sequence
  Targeting domain
cuguuggcuacauccauucc

SEQ ID NO: 1677 - RNA, 18 nt, Artificial Sequence
  Targeting domain
cagagugcauccaugguc

SEQ ID NO: 1678 - RNA, 24 nt, Artificial Sequence
  Targeting domain
cuccagcauuagaaaguccuaggc

SEQ ID NO: 1679 - RNA, 22 nt, Artificial Sequence
  Targeting domain
ccagcauuagaaaguccuaggc

SEQ ID NO: 1680 - RNA, 21 nt, Artificial Sequence
  Targeting domain
cagcauuagaaaguccuaggc

SEQ ID NO: 1681 - RNA, 18 nt, Artificial Sequence
  Targeting domain
cauuagaaaguccuaggc

SEQ ID NO: 1682 - RNA, 24 nt, Artificial Sequence
  Targeting domain
cccauggucccuggcuuuuguucc

SEQ ID NO: 1683 - RNA, 23 nt, Artificial Sequence
  Targeting domain
ccauggucccuggcuuuuguucc

SEQ ID NO: 1684 - RNA, 22 nt, Artificial Sequence
  Targeting domain
cauggucccuggcuuuuguucc

SEQ ID NO: 1685 - RNA, 22 nt, Artificial Sequence
  Targeting domain
cucauagagacacauucaguaa

SEQ ID NO: 1686 - skipped

SEQ ID NO: 1687 - RNA, 22 nt, Artificial Sequence
  Targeting domain
cucaaaagcuuuugcuggcuca

SEQ ID NO: 1688 - skipped

SEQ ID NO: 1689 - RNA, 21 nt, Artificial Sequence
  Targeting domain
ccauaagccucuauuucugau

SEQ ID NO: 1690 - skipped

SEQ ID NO: 1691 - RNA, 24 nt, Artificial Sequence
  Targeting domain
cagcuaaaucaugcaagugaccua

SEQ ID NO: 1692 - RNA, 21 nt, Artificial Sequence
  Targeting domain
cuaaaucaugcaagugaccua

SEQ ID NO: 1693 - RNA, 24 nt, Artificial Sequence
  Targeting domain
caaaccucuuuuaaccagacaucu

SEQ ID NO: 1694 - RNA, 20 nt, Artificial Sequence
  Targeting domain
ccucuuuuaaccagacaucu

SEQ ID NO: 1695 - RNA, 19 nt, Artificial Sequence
  Targeting domain
cucuuuuaaccagacaucu

SEQ ID NO: 1696 - skipped

SEQ ID NO: 1697 - RNA, 18 nt, Artificial Sequence
  Targeting domain
cauaauuuaguaggaauc

SEQ ID NO: 1698 - RNA, 22 nt, Artificial Sequence
  Targeting domain
caccucucuuuggcaaaagcag

SEQ ID NO: 1699 - skipped

SEQ ID NO: 1700 - RNA, 19 nt, Artificial Sequence
  Targeting domain
cucucuuuggcaaaagcag

SEQ ID NO: 1701 - RNA, 24 nt, Artificial Sequence
  Targeting domain
cagguagaauauuguaaucaaagg

SEQ ID NO: 1702 - RNA, 23 nt, Artificial Sequence
  Targeting domain
ccaaggaacaaaagccagggacc

SEQ ID NO: 1703 - RNA, 22 nt, Artificial Sequence
  Targeting domain
caaggaacaaaagccagggacc

SEQ ID NO: 1704 - RNA, 23 nt, Artificial Sequence
  Targeting domain
cauccauuccaaggaacaaaagc

SEQ ID NO: 1705 - RNA, 20 nt, Artificial Sequence
  Targeting domain
ccauuccaaggaacaaaagc

SEQ ID NO: 1706 - RNA, 19 nt, Artificial Sequence
  Targeting domain
cauuccaaggaacaaaagc

SEQ ID NO: 1707 - RNA, 24 nt, Artificial Sequence
  Targeting domain
cucuugccuaggacuuucuaaugc

SEQ ID NO: 1708 - RNA, 22 nt, Artificial Sequence
  Targeting domain
cuugccuaggacuuucuaaugc

SEQ ID NO: 1709 - RNA, 18 nt, Artificial Sequence
  Targeting domain
ccuaggacuuucuaaugc

SEQ ID NO: 1710 - RNA, 23 nt, Artificial Sequence
  Targeting domain
ccugauuuguucaucuuccucau

SEQ ID NO: 1711 - RNA, 22 nt, Artificial Sequence
  Targeting domain
cugauuuguucaucuuccucau

SEQ ID NO: 1712 - RNA, 22 nt, Artificial Sequence
  Targeting domain
ccucuuuuaaccagacaucuaa

SEQ ID NO: 1713 - RNA, 21 nt, Artificial Sequence
  Targeting domain
cucuuuuaaccagacaucuaa

SEQ ID NO: 1714 - RNA, 19 nt, Artificial Sequence
  Targeting domain
cuuuuaaccagacaucuaa

SEQ ID NO: 1715 - RNA, 24 nt, Artificial Sequence
  Targeting domain
ccucuguccuauccucuccagcau

SEQ ID NO: 1716 - RNA, 23 nt, Artificial Sequence
  Targeting domain
cucuguccuauccucuccagcau

SEQ ID NO: 1717 - RNA, 21 nt, Artificial Sequence
  Targeting domain
cuguccuauccucuccagcau

SEQ ID NO: 1718 - RNA, 23 nt, Artificial Sequence
  Targeting domain
cagguagaauauuguaaucaaag

SEQ ID NO: 1719 - RNA, 20 nt, Artificial Sequence
  Targeting domain
cuggguacagggguaagaga

SEQ ID NO: 1720 - RNA, 19 nt, Artificial Sequence
  Targeting domain
cuuucugcugcuuuugcca

SEQ ID NO: 1721 - RNA, 24 nt, Artificial Sequence
  Targeting domain
cagacaucuaagagaaaaaggagc

SEQ ID NO: 1722 - RNA, 20 nt, Artificial Sequence
  Targeting domain
caucuaagagaaaaaggagc

SEQ ID NO: 1723 - RNA, 24 nt, Artificial Sequence
  Targeting domain
cuggagaggauaggacagaggaca

SEQ ID NO: 1724 - RNA, 24 nt, Artificial Sequence
  Targeting domain
caaggaacaaaagccagggaccau

SEQ ID NO: 1725 - RNA, 23 nt, Artificial Sequence
  Targeting domain
cauuuauucuacaauaaaaaaug

SEQ ID NO: 1726 - RNA, 24 nt, Artificial Sequence
  Targeting domain
gcuacuguuggcuacauccauucc

SEQ ID NO: 1727 - RNA, 18 nt, Artificial Sequence
  Targeting domain
guuggcuacauccauucc

SEQ ID NO: 1728 - RNA, 19 nt, Artificial Sequence
  Targeting domain
gcauuagaaaguccuaggc

SEQ ID NO: 1729 - RNA, 19 nt, Artificial Sequence
  Targeting domain
ggucccuggcuuuuguucc

SEQ ID NO: 1730 - RNA, 18 nt, Artificial Sequence
  Targeting domain
gucccuggcuuuuguucc

SEQ ID NO: 1731 - RNA, 24 nt, Artificial Sequence
  Targeting domain
ggcucauagagacacauucaguaa

SEQ ID NO: 1732 - RNA, 23 nt, Artificial Sequence
  Targeting domain
gcucauagagacacauucaguaa

SEQ ID NO: 1733 - RNA, 23 nt, Artificial Sequence
  Targeting domain
gcucaaaagcuuuugcuggcuca

SEQ ID NO: 1734 - RNA, 22 nt, Artificial Sequence
  Targeting domain
gcuaaaucaugcaagugaccua

SEQ ID NO: 1735 - RNA, 23 nt, Artificial Sequence
  Targeting domain
guuuguucuggguacagggguaa

SEQ ID NO: 1736 - RNA, 19 nt, Artificial Sequence
  Targeting domain
guucuggguacagggguaa

SEQ ID NO: 1737 - RNA, 22 nt, Artificial Sequence
  CEP290-312/-926 targeting domain (RNA)
gacucauaauuuaguaggaauc

SEQ ID NO: 1738 - RNA, 23 nt, Artificial Sequence
  Targeting domain
ggaauggauguagccaacaguag

SEQ ID NO: 1739 - RNA, 22 nt, Artificial Sequence
  Targeting domain
gaauggauguagccaacaguag

SEQ ID NO: 1740 - RNA, 18 nt, Artificial Sequence
  Targeting domain
ggauguagccaacaguag

SEQ ID NO: 1741 - RNA, 22 nt, Artificial Sequence
  Targeting domain
gguagaauauuguaaucaaagg

SEQ ID NO: 1742 - RNA, 21 nt, Artificial Sequence
  Targeting domain
guagaauauuguaaucaaagg

SEQ ID NO: 1743 - RNA, 18 nt, Artificial Sequence
  Targeting domain
gaauauuguaaucaaagg

SEQ ID NO: 1744 - RNA, 19 nt, Artificial Sequence
  Targeting domain
ggaacaaaagccagggacc

SEQ ID NO: 1745 - RNA, 18 nt, Artificial Sequence
  Targeting domain
gaacaaaagccagggacc

SEQ ID NO: 1746 - RNA, 23 nt, Artificial Sequence
  Targeting domain
gaauuagaucuuauucuacuccu

SEQ ID NO: 1747 - RNA, 19 nt, Artificial Sequence
  Targeting domain
gccuaggacuuucuaaugc

SEQ ID NO: 1748 - skipped

SEQ ID NO: 1749 - RNA, 24 nt, Artificial Sequence
  Targeting domain
gagaggugauuauguuacuuuuua

SEQ ID NO: 1750 - RNA, 22 nt, Artificial Sequence
  Targeting domain
gaggugauuauguuacuuuuua

SEQ ID NO: 1751 - skipped

SEQ ID NO: 1752 - RNA, 19 nt, Artificial Sequence
  Targeting domain
gugauuauguuacuuuuua

SEQ ID NO: 1753 - RNA, 19 nt, Artificial Sequence
  Targeting domain
guccuauccucuccagcau

SEQ ID NO: 1754 - RNA, 23 nt, Artificial Sequence
  Targeting domain
gauaaacaugacucauaauuuag

SEQ ID NO: 1755 - RNA, 21 nt, Artificial Sequence
  Targeting domain
gguagaauauuguaaucaaag

SEQ ID NO: 1756 - RNA, 20 nt, Artificial Sequence
  Targeting domain
guagaauauuguaaucaaag

SEQ ID NO: 1757 - RNA, 23 nt, Artificial Sequence
  Targeting domain
guucuggguacagggguaagaga

SEQ ID NO: 1758 - RNA, 18 nt, Artificial Sequence
  Targeting domain
ggguacagggguaagaga

SEQ ID NO: 1759 - RNA, 21 nt, Artificial Sequence
  Targeting domain
guuuguucuggguacaggggu

SEQ ID NO: 1760 - RNA, 24 nt, Artificial Sequence
  Targeting domain
guuugcuuucugcugcuuuugcca

SEQ ID NO: 1761 - skipped

SEQ ID NO: 1762 - RNA, 22 nt, Artificial Sequence
  Targeting domain
gacaucuaagagaaaaaggagc

SEQ ID NO: 1763 - RNA, 22 nt, Artificial Sequence
  Targeting domain
ggagaggauaggacagaggaca

SEQ ID NO: 1764 - RNA, 21 nt, Artificial Sequence
  Targeting domain
gagaggauaggacagaggaca

SEQ ID NO: 1765 - RNA, 19 nt, Artificial Sequence
  Targeting domain
gaggauaggacagaggaca

SEQ ID NO: 1766 - RNA, 21 nt, Artificial Sequence
  Targeting domain
ggaaagaugaaaaauacucuu

SEQ ID NO: 1767 - RNA, 22 nt, Artificial Sequence
  Targeting domain
ggaaagaugaaaaauacucuuu

SEQ ID NO: 1768 - RNA, 21 nt, Artificial Sequence
  Targeting domain
gaaagaugaaaaauacucuuu

SEQ ID NO: 1769 - skipped

SEQ ID NO: 1770 - RNA, 19 nt, Artificial Sequence
  Targeting domain
gaaagaugaaaaauacucu

SEQ ID NO: 1771 - RNA, 24 nt, Artificial Sequence
  Targeting domain
ggauaggacagaggacauggagaa

SEQ ID NO: 1772 - RNA, 23 nt, Artificial Sequence
  Targeting domain
gauaggacagaggacauggagaa

SEQ ID NO: 1773 - RNA, 19 nt, Artificial Sequence
  Targeting domain
ggacagaggacauggagaa

SEQ ID NO: 1774 - RNA, 18 nt, Artificial Sequence
  Targeting domain
gacagaggacauggagaa

SEQ ID NO: 1775 - RNA, 23 nt, Artificial Sequence
  Targeting domain
ggauaggacagaggacauggaga

SEQ ID NO: 1776 - RNA, 22 nt, Artificial Sequence
  Targeting domain
gauaggacagaggacauggaga

SEQ ID NO: 1777 - RNA, 18 nt, Artificial Sequence
  Targeting domain
ggacagaggacauggaga

SEQ ID NO: 1778 - RNA, 21 nt, Artificial Sequence
  Targeting domain
ggaacaaaagccagggaccau

SEQ ID NO: 1779 - RNA, 21 nt, Artificial Sequence
  Targeting domain
guguguguguguguguguuau

SEQ ID NO: 1780 - RNA, 19 nt, Artificial Sequence
  Targeting domain
guguguguguguguguuau

SEQ ID NO: 1781 - RNA, 22 nt, Artificial Sequence
  Targeting domain
guguguguguguguguguuaug

SEQ ID NO: 1782 - skipped

SEQ ID NO: 1783 - RNA, 18 nt, Artificial Sequence
  Targeting domain
guguguguguguguuaug

SEQ ID NO: 1784 - RNA, 22 nt, Artificial Sequence
  Targeting domain
uacuguuggcuacauccauucc

SEQ ID NO: 1785 - RNA, 19 nt, Artificial Sequence
  CEP290-967 targeting domain (RNA)
uguuggcuacauccauucc

SEQ ID NO: 1786 - RNA, 22 nt, Artificial Sequence
  Targeting domain
uuuacagagugcauccaugguc

SEQ ID NO: 1787 - RNA, 21 nt, Artificial Sequence
  Targeting domain
uuacagagugcauccaugguc

SEQ ID NO: 1788 - RNA, 20 nt, Artificial Sequence
  Targeting domain
uacagagugcauccaugguc

SEQ ID NO: 1789 - RNA, 23 nt, Artificial Sequence
  Targeting domain
uccagcauuagaaaguccuaggc

SEQ ID NO: 1790 - RNA, 20 nt, Artificial Sequence
  Targeting domain
uggucccuggcuuuuguucc

SEQ ID NO: 1791 - RNA, 21 nt, Artificial Sequence
  Targeting domain
ucauagagacacauucaguaa

SEQ ID NO: 1792 - RNA, 18 nt, Artificial Sequence
  Targeting domain
uagagacacauucaguaa

SEQ ID NO: 1793 - RNA, 21 nt, Artificial Sequence
  Targeting domain
ucaaaagcuuuugcuggcuca

SEQ ID NO: 1794 - RNA, 22 nt, Artificial Sequence
  CEP290-985 targeting domain (RNA)
uccauaagccucuauuucugau

SEQ ID NO: 1795 - RNA, 18 nt, Artificial Sequence
  Targeting domain
uaagccucuauuucugau

SEQ ID NO: 1796 - RNA, 18 nt, Artificial Sequence
  CEP290-988 targeting domain (RNA)
ucuuuuaaccagacaucu

SEQ ID NO: 1797 - RNA, 22 nt, Artificial Sequence
  Targeting domain
uuuguucuggguacagggguaa

SEQ ID NO: 1798 - RNA, 21 nt, Artificial Sequence
  Targeting domain
uuguucuggguacagggguaa

SEQ ID NO: 1799 - RNA, 20 nt, Artificial Sequence
  Targeting domain
uguucuggguacagggguaa

SEQ ID NO: 1800 - RNA, 18 nt, Artificial Sequence
  CEP290-992 targeting domain (RNA)
uucuggguacagggguaa

SEQ ID NO: 1801 - RNA, 23 nt, Artificial Sequence
  Targeting domain
ugacucauaauuuaguaggaauc

SEQ ID NO: 1802 - RNA, 19 nt, Artificial Sequence
  Targeting domain
ucauaauuuaguaggaauc

SEQ ID NO: 1803 - RNA, 24 nt, Artificial Sequence
  Targeting domain
uggaauggauguagccaacaguag

SEQ ID NO: 1804 - RNA, 19 nt, Artificial Sequence
  Targeting domain
uggauguagccaacaguag

SEQ ID NO: 1805 - RNA, 23 nt, Artificial Sequence
  Targeting domain
ucaccucucuuuggcaaaagcag

SEQ ID NO: 1806 - RNA, 18 nt, Artificial Sequence
  Targeting domain
ucucuuuggcaaaagcag

SEQ ID NO: 1807 - RNA, 20 nt, Artificial Sequence
  Targeting domain
uagaauauuguaaucaaagg

SEQ ID NO: 1808 - RNA, 24 nt, Artificial Sequence
  Targeting domain
uccaaggaacaaaagccagggacc

SEQ ID NO: 1809 - RNA, 21 nt, Artificial Sequence
  CEP290-1001 targeting domain (RNA)
uccauuccaaggaacaaaagc

SEQ ID NO: 1810 - skipped

SEQ ID NO: 1811 - RNA, 19 nt, Artificial Sequence
  Targeting domain
uagaucuuauucuacuccu

SEQ ID NO: 1812 - RNA, 23 nt, Artificial Sequence
  Targeting domain
ucuugccuaggacuuucuaaugc

SEQ ID NO: 1813 - RNA, 21 nt, Artificial Sequence
  Targeting domain
uugccuaggacuuucuaaugc

SEQ ID NO: 1814 - RNA, 24 nt, Artificial Sequence
  Targeting domain
uccugauuuguucaucuuccucau

SEQ ID NO: 1815 - RNA, 21 nt, Artificial Sequence
  Targeting domain
ugauuuguucaucuuccucau

SEQ ID NO: 1816 - RNA, 18 nt, Artificial Sequence
  Targeting domain
uuuguucaucuuccucau

SEQ ID NO: 1817 - RNA, 18 nt, Artificial Sequence
  CEP290-1010 targeting domain (RNA)
ugauuauguuacuuuuua

SEQ ID NO: 1818 - RNA, 20 nt, Artificial Sequence
  CEP290-1011 targeting domain (RNA)
ucuuuuaaccagacaucuaa

SEQ ID NO: 1819 - RNA, 18 nt, Artificial Sequence
  Targeting domain
uuuuaaccagacaucuaa

SEQ ID NO: 1820 - RNA, 22 nt, Artificial Sequence
  Targeting domain
ucuguccuauccucuccagcau

SEQ ID NO: 1821 - skipped

SEQ ID NO: 1822 - RNA, 18 nt, Artificial Sequence
  Targeting domain
uccuauccucuccagcau

SEQ ID NO: 1823 - RNA, 24 nt, Artificial Sequence
  Targeting domain
ugauaaacaugacucauaauuuag

SEQ ID NO: 1824 - RNA, 21 nt, Artificial Sequence
  Targeting domain
uaaacaugacucauaauuuag

SEQ ID NO: 1825 - RNA, 19 nt, Artificial Sequence
  Targeting domain
uagaauauuguaaucaaag

SEQ ID NO: 1826 - RNA, 24 nt, Artificial Sequence
  Targeting domain
uguucuggguacagggguaagaga

SEQ ID NO: 1827 - RNA, 22 nt, Artificial Sequence
  Targeting domain
uucuggguacagggguaagaga

SEQ ID NO: 1828 - RNA, 21 nt, Artificial Sequence
  Targeting domain
ucuggguacagggguaagaga

SEQ ID NO: 1829 - RNA, 19 nt, Artificial Sequence
  Targeting domain
uggguacagggguaagaga

SEQ ID NO: 1830 - RNA, 23 nt, Artificial Sequence
  CEP290-1023 targeting domain (RNA)
uaguuuguucuggguacaggggu

SEQ ID NO: 1831 - RNA, 20 nt, Artificial Sequence
  Targeting domain
uuuguucuggguacaggggu

SEQ ID NO: 1832 - RNA, 19 nt, Artificial Sequence
  Targeting domain
uuguucuggguacaggggu

SEQ ID NO: 1833 - RNA, 18 nt, Artificial Sequence
  Targeting domain
uguucuggguacaggggu

SEQ ID NO: 1834 - RNA, 23 nt, Artificial Sequence
  Targeting domain
uuugcuuucugcugcuuuugcca

SEQ ID NO: 1835 - RNA, 22 nt, Artificial Sequence
  Targeting domain
uugcuuucugcugcuuuugcca

SEQ ID NO: 1836 - RNA, 21 nt, Artificial Sequence
  Targeting domain
ugcuuucugcugcuuuugcca

SEQ ID NO: 1837 - RNA, 18 nt, Artificial Sequence
  Targeting domain
uuucugcugcuuuugcca

SEQ ID NO: 1838 - RNA, 18 nt, Artificial Sequence
  Targeting domain
ucuaagagaaaaaggagc

SEQ ID NO: 1839 - RNA, 23 nt, Artificial Sequence
  Targeting domain
uggagaggauaggacagaggaca

SEQ ID NO: 1840 - RNA, 24 nt, Artificial Sequence
  Targeting domain
uuaggaaagaugaaaaauacucuu

SEQ ID NO: 1841 - RNA, 23 nt, Artificial Sequence
  CEP290-1034 targeting domain (RNA)
uaggaaagaugaaaaauacucuu

SEQ ID NO: 1842 - RNA, 24 nt, Artificial Sequence
  Targeting domain
uaggaaagaugaaaaauacucuuu

SEQ ID NO: 1843 - RNA, 24 nt, Artificial Sequence
  CEP290-1036 targeting domain (RNA)
uuuaggaaagaugaaaaauacucu

SEQ ID NO: 1844 - RNA, 23 nt, Artificial Sequence
  CEP290-1037 targeting domain (RNA)
uuaggaaagaugaaaaauacucu

SEQ ID NO: 1845 - RNA, 22 nt, Artificial Sequence
  Targeting domain
uaggaaagaugaaaaauacucu

SEQ ID NO: 1846 - RNA, 21 nt, Artificial Sequence
  Targeting domain
uaggacagaggacauggagaa

SEQ ID NO: 1847 - skipped

SEQ ID NO: 1848 - RNA, 21 nt, Artificial Sequence
  Targeting domain
uuuauucuacaauaaaaaaug

SEQ ID NO: 1849 - RNA, 20 nt, Artificial Sequence
  Targeting domain
uuauucuacaauaaaaaaug

SEQ ID NO: 1850 - RNA, 19 nt, Artificial Sequence
  Targeting domain
uauucuacaauaaaaaaug

SEQ ID NO: 1851 - RNA, 23 nt, Artificial Sequence
  Targeting domain
uuguguguguguguguguguuau

SEQ ID NO: 1852 - RNA, 22 nt, Artificial Sequence
  Targeting domain
uguguguguguguguguguuau

SEQ ID NO: 1853 - RNA, 20 nt, Artificial Sequence
  Targeting domain
uguguguguguguguguuau

SEQ ID NO: 1854 - RNA, 18 nt, Artificial Sequence
  Targeting domain
uguguguguguguguuau

SEQ ID NO: 1855 - RNA, 24 nt, Artificial Sequence
  Targeting domain
uuguguguguguguguguguuaug

SEQ ID NO: 1856 - RNA, 23 nt, Artificial Sequence
  Targeting domain
uguguguguguguguguguuaug

SEQ ID NO: 1857 - RNA, 21 nt, Artificial Sequence
  Targeting domain
uguguguguguguguguuaug

SEQ ID NO: 1858 - RNA, 19 nt, Artificial Sequence
  Targeting domain
uguguguguguguguuaug

SEQ ID NO: 1859 - RNA, 22 nt, Artificial Sequence
  Targeting domain
acuguuggcuacauccauucca

SEQ ID NO: 1860 - RNA, 24 nt, Artificial Sequence
  Targeting domain
auuauccacaagaugucucuugcc

SEQ ID NO: 1861 - RNA, 21 nt, Artificial Sequence
  Targeting domain
auccacaagaugucucuugcc

SEQ ID NO: 1862 - RNA, 18 nt, Artificial Sequence
  Targeting domain
augagccagcaaaagcuu

SEQ ID NO: 1863 - RNA, 23 nt, Artificial Sequence
  Targeting domain
acagagugcauccaugguccagg

SEQ ID NO: 1864 - RNA, 21 nt, Artificial Sequence
  Targeting domain
agagugcauccaugguccagg

SEQ ID NO: 1865 - RNA, 19 nt, Artificial Sequence
  CEP290-1058 targeting domain (RNA)
agugcauccaugguccagg

SEQ ID NO: 1866 - RNA, 23 nt, Artificial Sequence
  CEP290-1059 targeting domain (RNA)
agcugaaauauuaagggcucuuc

SEQ ID NO: 1867 - RNA, 18 nt, Artificial Sequence
  CEP290-1060 targeting domain (RNA)
aaauauuaagggcucuuc

SEQ ID NO: 1868 - RNA, 23 nt, Artificial Sequence
  CEP290-1061 targeting domain (RNA)
aacucuauaccuuuuacugagga

SEQ ID NO: 1869 - RNA, 22 nt, Artificial Sequence
  CEP290-1062 targeting domain (RNA)
acucuauaccuuuuacugagga

SEQ ID NO: 1870 - RNA, 23 nt, Artificial Sequence
  CEP290-1063 targeting domain (RNA)
acuugaacucuauaccuuuuacu

SEQ ID NO: 1871 - RNA, 18 nt, Artificial Sequence
  Targeting domain
aacucuauaccuuuuacu

SEQ ID NO: 1872 - RNA, 22 nt, Artificial Sequence
  Targeting domain
aguaggaauccugaaagcuacu

SEQ ID NO: 1873 - RNA, 19 nt, Artificial Sequence
  Targeting domain
aggaauccugaaagcuacu

SEQ ID NO: 1874 - RNA, 22 nt, Artificial Sequence
  Targeting domain
agccaacaguagcugaaauauu

SEQ ID NO: 1875 - RNA, 18 nt, Artificial Sequence
  Targeting domain
aacaguagcugaaauauu

SEQ ID NO: 1876 - RNA, 23 nt, Artificial Sequence
  Targeting domain
auccauuccaaggaacaaaagcc

SEQ ID NO: 1877 - RNA, 19 nt, Artificial Sequence
  Targeting domain
auuccaaggaacaaaagcc

SEQ ID NO: 1878 - RNA, 24 nt, Artificial Sequence
  Targeting domain
aucccuuucucuuaccccuguacc

SEQ ID NO: 1879 - RNA, 24 nt, Artificial Sequence
  Targeting domain
aggacuuucuaaugcuggagagga

SEQ ID NO: 1880 - RNA, 21 nt, Artificial Sequence
  Targeting domain
acuuucuaaugcuggagagga

SEQ ID NO: 1881 - RNA, 21 nt, Artificial Sequence
  Targeting domain
aaugcuggagaggauaggaca

SEQ ID NO: 1882 - skipped

SEQ ID NO: 1883 - RNA, 23 nt, Artificial Sequence
  Targeting domain
aucauaaguuacaaucugugaau

SEQ ID NO: 1884 - RNA, 20 nt, Artificial Sequence
  Targeting domain
auaaguuacaaucugugaau

SEQ ID NO: 1885 - RNA, 18 nt, Artificial Sequence
  Targeting domain
aaguuacaaucugugaau

SEQ ID NO: 1886 - RNA, 21 nt, Artificial Sequence
  Targeting domain
aaccagacaucuaagagaaaa

SEQ ID NO: 1887 - skipped

SEQ ID NO: 1888 - RNA, 24 nt, Artificial Sequence
  Targeting domain
aagccucuauuucugaugaggaag

SEQ ID NO: 1889 - RNA, 23 nt, Artificial Sequence
  Targeting domain
agccucuauuucugaugaggaag

SEQ ID NO: 1890 - skipped

SEQ ID NO: 1891 - RNA, 19 nt, Artificial Sequence
  Targeting domain
auuuacugaaugugucucu

SEQ ID NO: 1892 - RNA, 19 nt, Artificial Sequence
  Targeting domain
acagggguaagagaaaggg

SEQ ID NO: 1893 - RNA, 24 nt, Artificial Sequence
  Targeting domain
cuacuguuggcuacauccauucca

SEQ ID NO: 1894 - RNA, 21 nt, Artificial Sequence
  Targeting domain
cuguuggcuacauccauucca

SEQ ID NO: 1895 - RNA, 19 nt, Artificial Sequence
  Targeting domain
ccacaagaugucucuugcc

SEQ ID NO: 1896 - RNA, 18 nt, Artificial Sequence
  Targeting domain
cacaagaugucucuugcc

SEQ ID NO: 1897 - RNA, 24 nt, Artificial Sequence
  Targeting domain
ccuuuguaguuaucuuacagccac

SEQ ID NO: 1898 - RNA, 23 nt, Artificial Sequence
  Targeting domain
cuuuguaguuaucuuacagccac

SEQ ID NO: 1899 - RNA, 22 nt, Artificial Sequence
  Targeting domain
cucuaugagccagcaaaagcuu

SEQ ID NO: 1900 - skipped

SEQ ID NO: 1901 - RNA, 22 nt, Artificial Sequence
  Targeting domain
cagagugcauccaugguccagg

SEQ ID NO: 1902 - RNA, 21 nt, Artificial Sequence
  Targeting domain
cugaaauauuaagggcucuuc

SEQ ID NO: 1903 - RNA, 21 nt, Artificial Sequence
  Targeting domain
cucuauaccuuuuacugagga

SEQ ID NO: 1904 - RNA, 19 nt, Artificial Sequence
  Targeting domain
cuauaccuuuuacugagga

SEQ ID NO: 1905 - RNA, 24 nt, Artificial Sequence
  Targeting domain
cacuugaacucuauaccuuuuacu

SEQ ID NO: 1906 - RNA, 22 nt, Artificial Sequence
  Targeting domain
cuugaacucuauaccuuuuacu

SEQ ID NO: 1907 - RNA, 20 nt, Artificial Sequence
  Targeting domain
ccaacaguagcugaaauauu

SEQ ID NO: 1908 - RNA, 19 nt, Artificial Sequence
  Targeting domain
caacaguagcugaaauauu

SEQ ID NO: 1909 - RNA, 24 nt, Artificial Sequence
  Targeting domain
cauccauuccaaggaacaaaagcc

SEQ ID NO: 1910 - RNA, 21 nt, Artificial Sequence
  Targeting domain
ccauuccaaggaacaaaagcc

SEQ ID NO: 1911 - skipped

SEQ ID NO: 1912 - RNA, 22 nt, Artificial Sequence
  Targeting domain
cccuuucucuuaccccuguacc

SEQ ID NO: 1913 - RNA, 21 nt, Artificial Sequence
  Targeting domain
ccuuucucuuaccccuguacc

SEQ ID NO: 1914 - RNA, 20 nt, Artificial Sequence
  Targeting domain
cuuucucuuaccccuguacc

SEQ ID NO: 1915 - skipped

SEQ ID NO: 1916 - RNA, 23 nt, Artificial Sequence
  Targeting domain
cuaaugcuggagaggauaggaca

SEQ ID NO: 1917 - RNA, 21 nt, Artificial Sequence
  Targeting domain
cauaaguuacaaucugugaau

SEQ ID NO: 1918 - RNA, 19 nt, Artificial Sequence
  Targeting domain
ccagacaucuaagagaaaa

SEQ ID NO: 1919 - RNA, 18 nt, Artificial Sequence
  Targeting domain
cagacaucuaagagaaaa

SEQ ID NO: 1920 - RNA, 21 nt, Artificial Sequence
  Targeting domain
ccucuauuucugaugaggaag

SEQ ID NO: 1921 - skipped

SEQ ID NO: 1922 - RNA, 18 nt, Artificial Sequence
  Targeting domain
cuauuucugaugaggaag

SEQ ID NO: 1923 - RNA, 23 nt, Artificial Sequence
  Targeting domain
cugaugaggaagaugaacaaauc

SEQ ID NO: 1924 - skipped

SEQ ID NO: 1925 - RNA, 18 nt, Artificial Sequence
  Targeting domain
cagggguaagagaaaggg

SEQ ID NO: 1926 - RNA, 19 nt, Artificial Sequence
  Targeting domain
guuggcuacauccauucca

SEQ ID NO: 1927 - RNA, 19 nt, Artificial Sequence
  Targeting domain
guaguuaucuuacagccac

SEQ ID NO: 1928 - RNA, 24 nt, Artificial Sequence
  Targeting domain
gucucuaugagccagcaaaagcuu

SEQ ID NO: 1929 - RNA, 20 nt, Artificial Sequence
  Targeting domain
gagugcauccaugguccagg

SEQ ID NO: 1930 - RNA, 18 nt, Artificial Sequence
  Targeting domain
gugcauccaugguccagg

SEQ ID NO: 1931 - RNA, 22 nt, Artificial Sequence
  Targeting domain
gcugaaauauuaagggcucuuc

SEQ ID NO: 1932 - RNA, 19 nt, Artificial Sequence
  Targeting domain
gaaauauuaagggcucuuc

SEQ ID NO: 1933 - RNA, 24 nt, Artificial Sequence
  Targeting domain
gaacucuauaccuuuuacugagga

SEQ ID NO: 1934 - RNA, 19 nt, Artificial Sequence
  Targeting domain
gaacucuauaccuuuuacu

SEQ ID NO: 1935 - RNA, 21 nt, Artificial Sequence
  Targeting domain
guaggaauccugaaagcuacu

SEQ ID NO: 1936 - RNA, 18 nt, Artificial Sequence
  Targeting domain
ggaauccugaaagcuacu

SEQ ID NO: 1937 - RNA, 24 nt, Artificial Sequence
  Targeting domain
guagccaacaguagcugaaauauu

SEQ ID NO: 1938 - RNA, 21 nt, Artificial Sequence
  Targeting domain
gccaacaguagcugaaauauu

SEQ ID NO: 1939 - RNA, 23 nt, Artificial Sequence
  Targeting domain
ggacuuucuaaugcuggagagga

SEQ ID NO: 1940 - RNA, 22 nt, Artificial Sequence
  CEP290-1133 targeting domain (RNA)
gacuuucuaaugcuggagagga

SEQ ID NO: 1941 - RNA, 18 nt, Artificial Sequence
  Targeting domain
gcuggagaggauaggaca

SEQ ID NO: 1942 - RNA, 22 nt, Artificial Sequence
  Targeting domain
gccucuauuucugaugaggaag

SEQ ID NO: 1943 - RNA, 21 nt, Artificial Sequence
  Targeting domain
gaugaggaagaugaacaaauc

SEQ ID NO: 1944 - RNA, 18 nt, Artificial Sequence
  Targeting domain
gaggaagaugaacaaauc

SEQ ID NO: 1945 - RNA, 23 nt, Artificial Sequence
  Targeting domain
ggguacagggguaagagaaaggg

SEQ ID NO: 1946 - RNA, 22 nt, Artificial Sequence
  Targeting domain
gguacagggguaagagaaaggg

SEQ ID NO: 1947 - RNA, 21 nt, Artificial Sequence
  Targeting domain
guacagggguaagagaaaggg

SEQ ID NO: 1948 - RNA, 23 nt, Artificial Sequence
  Targeting domain
guguguguguguguguguuaugu

SEQ ID NO: 1949 - RNA, 21 nt, Artificial Sequence
  Targeting domain
guguguguguguguguuaugu

SEQ ID NO: 1950 - RNA, 19 nt, Artificial Sequence
  Targeting domain
guguguguguguguuaugu

SEQ ID NO: 1951 - RNA, 23 nt, Artificial Sequence
  Targeting domain
uacuguuggcuacauccauucca

SEQ ID NO: 1952 - RNA, 20 nt, Artificial Sequence
  Targeting domain
uguuggcuacauccauucca

SEQ ID NO: 1953 - RNA, 18 nt, Artificial Sequence
  Targeting domain
uuggcuacauccauucca

SEQ ID NO: 1954 - RNA, 23 nt, Artificial Sequence
  Targeting domain
uuauccacaagaugucucuugcc

SEQ ID NO: 1955 - RNA, 22 nt, Artificial Sequence
  Targeting domain
uauccacaagaugucucuugcc

SEQ ID NO: 1956 - skipped

SEQ ID NO: 1957 - RNA, 22 nt, Artificial Sequence
  Targeting domain
uuuguaguuaucuuacagccac

SEQ ID NO: 1958 - RNA, 21 nt, Artificial Sequence
  Targeting domain
uuguaguuaucuuacagccac

SEQ ID NO: 1959 - RNA, 20 nt, Artificial Sequence
  Targeting domain
uguaguuaucuuacagccac

SEQ ID NO: 1960 - RNA, 18 nt, Artificial Sequence
  Targeting domain
uaguuaucuuacagccac

SEQ ID NO: 1961 - RNA, 23 nt, Artificial Sequence
  Targeting domain
ucucuaugagccagcaaaagcuu

SEQ ID NO: 1962 - RNA, 21 nt, Artificial Sequence
  Targeting domain
ucuaugagccagcaaaagcuu

SEQ ID NO: 1963 - RNA, 19 nt, Artificial Sequence
  Targeting domain
uaugagccagcaaaagcuu

SEQ ID NO: 1964 - RNA, 24 nt, Artificial Sequence
  Targeting domain
uacagagugcauccaugguccagg

SEQ ID NO: 1965 - RNA, 24 nt, Artificial Sequence
  Targeting domain
uagcugaaauauuaagggcucuuc

SEQ ID NO: 1966 - RNA, 20 nt, Artificial Sequence
  Targeting domain
ugaaauauuaagggcucuuc

SEQ ID NO: 1967 - skipped

SEQ ID NO: 1968 - RNA, 18 nt, Artificial Sequence
  Targeting domain
uauaccuuuuacugagga

SEQ ID NO: 1969 - RNA, 21 nt, Artificial Sequence
  Targeting domain
uugaacucuauaccuuuuacu

SEQ ID NO: 1970 - RNA, 20 nt, Artificial Sequence
  Targeting domain
ugaacucuauaccuuuuacu

SEQ ID NO: 1971 - RNA, 24 nt, Artificial Sequence
  Targeting domain
uuaguaggaauccugaaagcuacu

SEQ ID NO: 1972 - RNA, 23 nt, Artificial Sequence
  Targeting domain
uaguaggaauccugaaagcuacu

SEQ ID NO: 1973 - skipped

SEQ ID NO: 1974 - RNA, 23 nt, Artificial Sequence
  Targeting domain
uagccaacaguagcugaaauauu

SEQ ID NO: 1975 - RNA, 22 nt, Artificial Sequence
  Targeting domain
uccauuccaaggaacaaaagcc

SEQ ID NO: 1976 - RNA, 18 nt, Artificial Sequence
  Targeting domain
uuccaaggaacaaaagcc

SEQ ID NO: 1977 - RNA, 23 nt, Artificial Sequence
  Targeting domain
ucccuuucucuuaccccuguacc

SEQ ID NO: 1978 - RNA, 19 nt, Artificial Sequence
  Targeting domain
uuucucuuaccccuguacc

SEQ ID NO: 1979 - RNA, 18 nt, Artificial Sequence
  Targeting domain
uucucuuaccccuguacc

SEQ ID NO: 1980 - RNA, 19 nt, Artificial Sequence
  Targeting domain
uuucuaaugcuggagagga

SEQ ID NO: 1981 - RNA, 18 nt, Artificial Sequence
  Targeting domain
uucuaaugcuggagagga

SEQ ID NO: 1982 - RNA, 24 nt, Artificial Sequence
  Targeting domain
ucuaaugcuggagaggauaggaca

SEQ ID NO: 1983 - RNA, 22 nt, Artificial Sequence
  Targeting domain
uaaugcuggagaggauaggaca

SEQ ID NO: 1984 - RNA, 19 nt, Artificial Sequence
  Targeting domain
ugcuggagaggauaggaca

SEQ ID NO: 1985 - RNA, 24 nt, Artificial Sequence
  Targeting domain
uaucauaaguuacaaucugugaau

SEQ ID NO: 1986 - RNA, 22 nt, Artificial Sequence
  Targeting domain
ucauaaguuacaaucugugaau

SEQ ID NO: 1987 - RNA, 19 nt, Artificial Sequence
  Targeting domain
uaaguuacaaucugugaau

SEQ ID NO: 1988 - RNA, 24 nt, Artificial Sequence
  Targeting domain
uuuaaccagacaucuaagagaaaa

SEQ ID NO: 1989 - RNA, 23 nt, Artificial Sequence
  Targeting domain
uuaaccagacaucuaagagaaaa

SEQ ID NO: 1990 - RNA, 22 nt, Artificial Sequence
  Targeting domain
uaaccagacaucuaagagaaaa

SEQ ID NO: 1991 - RNA, 19 nt, Artificial Sequence
  Targeting domain
ucuauuucugaugaggaag

SEQ ID NO: 1992 - RNA, 24 nt, Artificial Sequence
  Targeting domain
ucugaugaggaagaugaacaaauc

SEQ ID NO: 1993 - RNA, 22 nt, Artificial Sequence
  Targeting domain
ugaugaggaagaugaacaaauc

SEQ ID NO: 1994 - RNA, 19 nt, Artificial Sequence
  Targeting domain
ugaggaagaugaacaaauc

SEQ ID NO: 1995 - RNA, 24 nt, Artificial Sequence
  Targeting domain
uuuucauuuacugaaugugucucu

SEQ ID NO: 1996 - RNA, 23 nt, Artificial Sequence
  Targeting domain
uuucauuuacugaaugugucucu

SEQ ID NO: 1997 - RNA, 22 nt, Artificial Sequence
  Targeting domain
uucauuuacugaaugugucucu

SEQ ID NO: 1998 - RNA, 21 nt, Artificial Sequence
  Targeting domain
ucauuuacugaaugugucucu

SEQ ID NO: 1999 - RNA, 18 nt, Artificial Sequence
  Targeting domain
uuuacugaaugugucucu

SEQ ID NO: 2000 - RNA, 24 nt, Artificial Sequence
  Targeting domain
uggguacagggguaagagaaaggg

SEQ ID NO: 2001 - RNA, 20 nt, Artificial Sequence
  Targeting domain
uacagggguaagagaaaggg

SEQ ID NO: 2002 - RNA, 24 nt, Artificial Sequence
  Targeting domain
uguguguguguguguguguuaugu

SEQ ID NO: 2003 - RNA, 22 nt, Artificial Sequence
  Targeting domain
uguguguguguguguguuaugu

SEQ ID NO: 2004 - skipped

SEQ ID NO: 2005 - RNA, 18 nt, Artificial Sequence
  Targeting domain
uguguguguguguuaugu

SEQ ID NO: 2006 - RNA, 24 nt, Artificial Sequence
  Targeting domain
auuuacagagugcauccauggucc

SEQ ID NO: 2007 - skipped

SEQ ID NO: 2008 - RNA, 18 nt, Artificial Sequence
  Targeting domain
agagugcauccauggucc

SEQ ID NO: 2009 - RNA, 21 nt, Artificial Sequence
  Targeting domain
acuugaacucuauaccuuuua

SEQ ID NO: 2010 - RNA, 22 nt, Artificial Sequence
  CEP290-1203 targeting domain (RNA)
agcuaaaucaugcaagugaccu

SEQ ID NO: 2011 - RNA, 18 nt, Artificial Sequence
  Targeting domain
aaaucaugcaagugaccu

SEQ ID NO: 2012 - RNA, 24 nt, Artificial Sequence
  Targeting domain
auccauaagccucuauuucugaug

SEQ ID NO: 2013 - skipped

SEQ ID NO: 2014 - RNA, 18 nt, Artificial Sequence
  Targeting domain
aagccucuauuucugaug

SEQ ID NO: 2015 - RNA, 20 nt, Artificial Sequence
  Targeting domain
agaauaguuuguucugggua

SEQ ID NO: 2016 - RNA, 18 nt, Artificial Sequence
  Targeting domain
aauaguuuguucugggua

SEQ ID NO: 2017 - RNA, 24 nt, Artificial Sequence
  Targeting domain
aggagaaugaucuagauaaucauu

SEQ ID NO: 2018 - RNA, 21 nt, Artificial Sequence
  Targeting domain
agaaugaucuagauaaucauu

SEQ ID NO: 2019 - RNA, 19 nt, Artificial Sequence
  Targeting domain
aaugaucuagauaaucauu

SEQ ID NO: 2020 - RNA, 18 nt, Artificial Sequence
  Targeting domain
augaucuagauaaucauu

SEQ ID NO: 2021 - RNA, 19 nt, Artificial Sequence
  Targeting domain
aaugcuggagaggauagga

SEQ ID NO: 2022 - RNA, 18 nt, Artificial Sequence
  Targeting domain
augcuggagaggauagga

SEQ ID NO: 2023 - RNA, 24 nt, Artificial Sequence
  Targeting domain
aaaauccauaagccucuauuucug

SEQ ID NO: 2024 - RNA, 23 nt, Artificial Sequence
  Targeting domain
aaauccauaagccucuauuucug

SEQ ID NO: 2025 - RNA, 22 nt, Artificial Sequence
  Targeting domain
aauccauaagccucuauuucug

SEQ ID NO: 2026 - RNA, 21 nt, Artificial Sequence
  Targeting domain
auccauaagccucuauuucug

SEQ ID NO: 2027 - RNA, 23 nt, Artificial Sequence
  Targeting domain
aaacagguagaauauuguaauca

SEQ ID NO: 2028 - RNA, 22 nt, Artificial Sequence
  Targeting domain
aacagguagaauauuguaauca

SEQ ID NO: 2029 - RNA, 21 nt, Artificial Sequence
  Targeting domain
acagguagaauauuguaauca

SEQ ID NO: 2030 - RNA, 19 nt, Artificial Sequence
  Targeting domain
agguagaauauuguaauca

SEQ ID NO: 2031 - RNA, 22 nt, Artificial Sequence
  CEP290-1224 targeting domain (RNA)
aaggaacaaaagccagggacca

SEQ ID NO: 2032 - RNA, 21 nt, Artificial Sequence
  CEP290-1225 targeting domain (RNA)
aggaacaaaagccagggacca

SEQ ID NO: 2033 - RNA, 18 nt, Artificial Sequence
  Targeting domain
aacaaaagccagggacca

SEQ ID NO: 2034 - RNA, 24 nt, Artificial Sequence
  Targeting domain
agguagaauauuguaaucaaagga

SEQ ID NO: 2035 - skipped

SEQ ID NO: 2036 - RNA, 18 nt, Artificial Sequence
  Targeting domain
aauauuguaaucaaagga

SEQ ID NO: 2037 - RNA, 22 nt, Artificial Sequence
  CEP290-1230 targeting domain (RNA)
agucauguuuaucaauauuauu

SEQ ID NO: 2038 - RNA, 18 nt, Artificial Sequence
  Targeting domain
auguuuaucaauauuauu

SEQ ID NO: 2039 - RNA, 20 nt, Artificial Sequence
  Targeting domain
aaccagacaucuaagagaaa

SEQ ID NO: 2040 - RNA, 19 nt, Artificial Sequence
  Targeting domain
accagacaucuaagagaaa

SEQ ID NO: 2041 - RNA, 22 nt, Artificial Sequence
  Targeting domain
auucuuaucuaagauccuuuca

SEQ ID NO: 2042 - RNA, 24 nt, Artificial Sequence
  CEP290-1235 targeting domain (RNA)
aaacagguagaauauuguaaucaa

SEQ ID NO: 2043 - RNA, 23 nt, Artificial Sequence
  CEP290-1236 targeting domain (RNA)
aacagguagaauauuguaaucaa

SEQ ID NO: 2044 - RNA, 22 nt, Artificial Sequence
  Targeting domain
acagguagaauauuguaaucaa

SEQ ID NO: 2045 - skipped

SEQ ID NO: 2046 - RNA, 19 nt, Artificial Sequence
  Targeting domain
augaggaagaugaacaaau

SEQ ID NO: 2047 - RNA, 19 nt, Artificial Sequence
  Targeting domain
agaggauaggacagaggac

SEQ ID NO: 2048 - RNA, 19 nt, Artificial Sequence
  Targeting domain
cagagugcauccauggucc

SEQ ID NO: 2049 - RNA, 24 nt, Artificial Sequence
  Targeting domain
cuugccuaggacuuucuaaugcug

SEQ ID NO: 2050 - skipped

SEQ ID NO: 2051 - RNA, 19 nt, Artificial Sequence
  Targeting domain
cuaggacuuucuaaugcug

SEQ ID NO: 2052 - RNA, 23 nt, Artificial Sequence
  CEP290-1245 targeting domain (RNA)
ccacuugaacucuauaccuuuua

SEQ ID NO: 2053 - RNA, 22 nt, Artificial Sequence
  Targeting domain
cacuugaacucuauaccuuuua

SEQ ID NO: 2054 - RNA, 20 nt, Artificial Sequence
  Targeting domain
cuugaacucuauaccuuuua

SEQ ID NO: 2055 - RNA, 23 nt, Artificial Sequence
  Targeting domain
cagcuaaaucaugcaagugaccu

SEQ ID NO: 2056 - RNA, 20 nt, Artificial Sequence
  Targeting domain
cuaaaucaugcaagugaccu

SEQ ID NO: 2057 - RNA, 23 nt, Artificial Sequence
  Targeting domain
cucuugccuaggacuuucuaaug

SEQ ID NO: 2058 - RNA, 21 nt, Artificial Sequence
  Targeting domain
cuugccuaggacuuucuaaug

SEQ ID NO: 2059 - RNA, 22 nt, Artificial Sequence
  Targeting domain
ccauaagccucuauuucugaug

SEQ ID NO: 2060 - RNA, 21 nt, Artificial Sequence
  Targeting domain
cauaagccucuauuucugaug

SEQ ID NO: 2061 - RNA, 21 nt, Artificial Sequence
  Targeting domain
cuaaugcuggagaggauagga

SEQ ID NO: 2062 - RNA, 19 nt, Artificial Sequence
  Targeting domain
ccauaagccucuauuucug

SEQ ID NO: 2063 - RNA, 18 nt, Artificial Sequence
  Targeting domain
cauaagccucuauuucug

SEQ ID NO: 2064 - RNA, 20 nt, Artificial Sequence
  Targeting domain
cagguagaauauuguaauca

SEQ ID NO: 2065 - RNA, 21 nt, Artificial Sequence
  Targeting domain
cuuucugcugcuuuugccaaa

SEQ ID NO: 2066 - RNA, 24 nt, Artificial Sequence
  Targeting domain
ccaaggaacaaaagccagggacca

SEQ ID NO: 2067 - RNA, 23 nt, Artificial Sequence
  Targeting domain
caaggaacaaaagccagggacca

SEQ ID NO: 2068 - RNA, 19 nt, Artificial Sequence
  Targeting domain
cucuuagaugucugguuaa

SEQ ID NO: 2069 - RNA, 19 nt, Artificial Sequence
  Targeting domain
cauguuuaucaauauuauu

SEQ ID NO: 2070 - RNA, 18 nt, Artificial Sequence
  Targeting domain
ccagacaucuaagagaaa

SEQ ID NO: 2071 - RNA, 19 nt, Artificial Sequence
  Targeting domain
cuuaucuaagauccuuuca

SEQ ID NO: 2072 - RNA, 21 nt, Artificial Sequence
  Targeting domain
cagguagaauauuguaaucaa

SEQ ID NO: 2073 - RNA, 22 nt, Artificial Sequence
  Targeting domain
cugaugaggaagaugaacaaau

SEQ ID NO: 2074 - RNA, 23 nt, Artificial Sequence
  Targeting domain
cuggagaggauaggacagaggac

SEQ ID NO: 2075 - RNA, 18 nt, Artificial Sequence
  Targeting domain
caucuuccucaucagaaa

SEQ ID NO: 2076 - RNA, 21 nt, Artificial Sequence
  Targeting domain
gccuaggacuuucuaaugcug

SEQ ID NO: 2077 - RNA, 24 nt, Artificial Sequence
  CEP290-1270 targeting domain (RNA)
gccacuugaacucuauaccuuuua

SEQ ID NO: 2078 - RNA, 21 nt, Artificial Sequence
  Targeting domain
gcuaaaucaugcaagugaccu

SEQ ID NO: 2079 - RNA, 18 nt, Artificial Sequence
  Targeting domain
gccuaggacuuucuaaug

SEQ ID NO: 2080 - RNA, 23 nt, Artificial Sequence
  Targeting domain
gggagaauaguuuguucugggua

SEQ ID NO: 2081 - RNA, 22 nt, Artificial Sequence
  Targeting domain
ggagaauaguuuguucugggua

SEQ ID NO: 2082 - RNA, 21 nt, Artificial Sequence
  Targeting domain
gagaauaguuuguucugggua

SEQ ID NO: 2083 - RNA, 19 nt, Artificial Sequence
  Targeting domain
gaauaguuuguucugggua

SEQ ID NO: 2084 - RNA, 23 nt, Artificial Sequence
  Targeting domain
ggagaaugaucuagauaaucauu

SEQ ID NO: 2085 - RNA, 22 nt, Artificial Sequence
  Targeting domain
gagaaugaucuagauaaucauu

SEQ ID NO: 2086 - RNA, 20 nt, Artificial Sequence
  Targeting domain
gaaugaucuagauaaucauu

SEQ ID NO: 2087 - RNA, 24 nt, Artificial Sequence
  Targeting domain
gaaacagguagaauauuguaauca

SEQ ID NO: 2088 - RNA, 18 nt, Artificial Sequence
  Targeting domain
gguagaauauuguaauca

SEQ ID NO: 2089 - RNA, 22 nt, Artificial Sequence
  Targeting domain
gcuuucugcugcuuuugccaaa

SEQ ID NO: 2090 - RNA, 19 nt, Artificial Sequence
  Targeting domain
gaacaaaagccagggacca

SEQ ID NO: 2091 - RNA, 23 nt, Artificial Sequence
  Targeting domain
gguagaauauuguaaucaaagga

SEQ ID NO: 2092 - RNA, 22 nt, Artificial Sequence
  Targeting domain
guagaauauuguaaucaaagga

SEQ ID NO: 2093 - RNA, 19 nt, Artificial Sequence
  Targeting domain
gaauauuguaaucaaagga

SEQ ID NO: 2094 - RNA, 23 nt, Artificial Sequence
  Targeting domain
gagucauguuuaucaauauuauu

SEQ ID NO: 2095 - RNA, 21 nt, Artificial Sequence
  Targeting domain
gucauguuuaucaauauuauu

SEQ ID NO: 2096 - RNA, 19 nt, Artificial Sequence
  Targeting domain
gguagaauauuguaaucaa

SEQ ID NO: 2097 - RNA, 18 nt, Artificial Sequence
  Targeting domain
guagaauauuguaaucaa

SEQ ID NO: 2098 - skipped

SEQ ID NO: 2099 - RNA, 24 nt, Artificial Sequence
  Targeting domain
gcuggagaggauaggacagaggac

SEQ ID NO: 2100 - RNA, 21 nt, Artificial Sequence
  Targeting domain
ggagaggauaggacagaggac

SEQ ID NO: 2101 - skipped

SEQ ID NO: 2102 - RNA, 18 nt, Artificial Sequence
  Targeting domain
gaggauaggacagaggac

SEQ ID NO: 2103 - RNA, 21 nt, Artificial Sequence
  Targeting domain
guucaucuuccucaucagaaa

SEQ ID NO: 2104 - RNA, 23 nt, Artificial Sequence
  Targeting domain
uuuacagagugcauccauggucc

SEQ ID NO: 2105 - RNA, 22 nt, Artificial Sequence
  Targeting domain
uuacagagugcauccauggucc

SEQ ID NO: 2106 - RNA, 21 nt, Artificial Sequence
  Targeting domain
uacagagugcauccauggucc

SEQ ID NO: 2107 - RNA, 23 nt, Artificial Sequence
  Targeting domain
uugccuaggacuuucuaaugcug

SEQ ID NO: 2108 - RNA, 22 nt, Artificial Sequence
  Targeting domain
ugccuaggacuuucuaaugcug

SEQ ID NO: 2109 - RNA, 18 nt, Artificial Sequence
  Targeting domain
uaggacuuucuaaugcug

SEQ ID NO: 2110 - RNA, 19 nt, Artificial Sequence
  Targeting domain
uugaacucuauaccuuuua

SEQ ID NO: 2111 - RNA, 18 nt, Artificial Sequence
  Targeting domain
ugaacucuauaccuuuua

SEQ ID NO: 2112 - RNA, 24 nt, Artificial Sequence
  Targeting domain
ucagcuaaaucaugcaagugaccu

SEQ ID NO: 2113 - RNA, 19 nt, Artificial Sequence
  Targeting domain
uaaaucaugcaagugaccu

SEQ ID NO: 2114 - RNA, 24 nt, Artificial Sequence
  Targeting domain
ucucuugccuaggacuuucuaaug

SEQ ID NO: 2115 - RNA, 22 nt, Artificial Sequence
  Targeting domain
ucuugccuaggacuuucuaaug

SEQ ID NO: 2116 - skipped

SEQ ID NO: 2117 - RNA, 19 nt, Artificial Sequence
  Targeting domain
ugccuaggacuuucuaaug

SEQ ID NO: 2118 - RNA, 23 nt, Artificial Sequence
  Targeting domain
uccauaagccucuauuucugaug

SEQ ID NO: 2119 - RNA, 19 nt, Artificial Sequence
  Targeting domain
uaagccucuauuucugaug

SEQ ID NO: 2120 - RNA, 24 nt, Artificial Sequence
  Targeting domain
ugggagaauaguuuguucugggua

SEQ ID NO: 2121 - RNA, 24 nt, Artificial Sequence
  Targeting domain
uuucuaaugcuggagaggauagga

SEQ ID NO: 2122 - RNA, 23 nt, Artificial Sequence
  Targeting domain
uucuaaugcuggagaggauagga

SEQ ID NO: 2123 - RNA, 22 nt, Artificial Sequence
  Targeting domain
ucuaaugcuggagaggauagga

SEQ ID NO: 2124-2125 - skipped (2 entries)

SEQ ID NO: 2126 - RNA, 24 nt, Artificial Sequence
  Targeting domain
uugcuuucugcugcuuuugccaaa

SEQ ID NO: 2127 - RNA, 23 nt, Artificial Sequence
  Targeting domain
ugcuuucugcugcuuuugccaaa

SEQ ID NO: 2128 - skipped

SEQ ID NO: 2129 - RNA, 19 nt, Artificial Sequence
  Targeting domain
uucugcugcuuuugccaaa

SEQ ID NO: 2130 - RNA, 18 nt, Artificial Sequence
  Targeting domain
ucugcugcuuuugccaaa

SEQ ID NO: 2131 - RNA, 21 nt, Artificial Sequence
  Targeting domain
uagaauauuguaaucaaagga

SEQ ID NO: 2132 - RNA, 24 nt, Artificial Sequence
  Targeting domain
uuuuucucuuagaugucugguuaa

SEQ ID NO: 2133 - RNA, 23 nt, Artificial Sequence
  Targeting domain
uuuucucuuagaugucugguuaa

SEQ ID NO: 2134 - RNA, 22 nt, Artificial Sequence
  Targeting domain
uuucucuuagaugucugguuaa

SEQ ID NO: 2135 - RNA, 21 nt, Artificial Sequence
  Targeting domain
uucucuuagaugucugguuaa

SEQ ID NO: 2136 - RNA, 20 nt, Artificial Sequence
  Targeting domain
ucucuuagaugucugguuaa

SEQ ID NO: 2137 - RNA, 18 nt, Artificial Sequence
  Targeting domain
ucuuagaugucugguuaa

SEQ ID NO: 2138 - RNA, 24 nt, Artificial Sequence
  Targeting domain
ugagucauguuuaucaauauuauu

SEQ ID NO: 2139 - skipped

SEQ ID NO: 2140 - RNA, 24 nt, Artificial Sequence
  Targeting domain
uuuuaaccagacaucuaagagaaa

SEQ ID NO: 2141 - RNA, 23 nt, Artificial Sequence
  Targeting domain
uuuaaccagacaucuaagagaaa

SEQ ID NO: 2142 - RNA, 22 nt, Artificial Sequence
  Targeting domain
uuaaccagacaucuaagagaaa

SEQ ID NO: 2143 - RNA, 21 nt, Artificial Sequence
  Targeting domain
uaaccagacaucuaagagaaa

SEQ ID NO: 2144 - RNA, 24 nt, Artificial Sequence
  Targeting domain
uuauucuuaucuaagauccuuuca

SEQ ID NO: 2145 - RNA, 23 nt, Artificial Sequence
  Targeting domain
uauucuuaucuaagauccuuuca

SEQ ID NO: 2146 - RNA, 21 nt, Artificial Sequence
  Targeting domain
uucuuaucuaagauccuuuca

SEQ ID NO: 2147 - skipped

SEQ ID NO: 2148 - RNA, 18 nt, Artificial Sequence
  Targeting domain
uuaucuaagauccuuuca

SEQ ID NO: 2149 - RNA, 24 nt, Artificial Sequence
  Targeting domain
uucugaugaggaagaugaacaaau

SEQ ID NO: 2150 - RNA, 23 nt, Artificial Sequence
  Targeting domain
ucugaugaggaagaugaacaaau

SEQ ID NO: 2151 - RNA, 21 nt, Artificial Sequence
  Targeting domain
ugaugaggaagaugaacaaau

SEQ ID NO: 2152 - RNA, 18 nt, Artificial Sequence
  Targeting domain
ugaggaagaugaacaaau

SEQ ID NO: 2153 - RNA, 22 nt, Artificial Sequence
  Targeting domain
uggagaggauaggacagaggac

SEQ ID NO: 2154 - RNA, 24 nt, Artificial Sequence
  Targeting domain
uuuguucaucuuccucaucagaaa

SEQ ID NO: 2155 - RNA, 23 nt, Artificial Sequence
  Targeting domain
uuguucaucuuccucaucagaaa

SEQ ID NO: 2156 - RNA, 22 nt, Artificial Sequence
  Targeting domain
uguucaucuuccucaucagaaa

SEQ ID NO: 2157 - skipped

SEQ ID NO: 2158 - RNA, 19 nt, Artificial Sequence
  Targeting domain
ucaucuuccucaucagaaa

SEQ ID NO: 2159 - RNA, 23 nt, Artificial Sequence
  Targeting domain
acuuaccucaugucaucuagagc

SEQ ID NO: 2160 - RNA, 19 nt, Artificial Sequence
  Targeting domain
accucaugucaucuagagc

SEQ ID NO: 2161 - RNA, 24 nt, Artificial Sequence
  Targeting domain
acaguuuuuaaggcggggagucac

SEQ ID NO: 2162 - RNA, 22 nt, Artificial Sequence
  Targeting domain
aguuuuuaaggcggggagucac

SEQ ID NO: 2163 - RNA, 19 nt, Artificial Sequence
  Targeting domain
acagaguucaagcuaauac

SEQ ID NO: 2164 - RNA, 24 nt, Artificial Sequence
  Targeting domain
auuagcuugaacucugugccaaac

SEQ ID NO: 2165 - RNA, 21 nt, Artificial Sequence
  Targeting domain
agcuugaacucugugccaaac

SEQ ID NO: 2166 - RNA, 22 nt, Artificial Sequence
  Targeting domain
auguggugucaaauauggugcu

SEQ ID NO: 2167 - RNA, 23 nt, Artificial Sequence
  Targeting domain
auguggugucaaauauggugcuu

SEQ ID NO: 2168 - RNA, 18 nt, Artificial Sequence
  Targeting domain
agaugacaugagguaagu

SEQ ID NO: 2169 - RNA, 22 nt, Artificial Sequence
  Targeting domain
aauacaugagagugauuagugg

SEQ ID NO: 2170 - RNA, 21 nt, Artificial Sequence
  Targeting domain
auacaugagagugauuagugg

SEQ ID NO: 2171 - RNA, 19 nt, Artificial Sequence
  Targeting domain
acaugagagugauuagugg

SEQ ID NO: 2172-2175 - skipped (4 entries)

SEQ ID NO: 2176 - RNA, 23 nt, Artificial Sequence
  Targeting domain
aaagguucaugagacuagagguc

SEQ ID NO: 2177 - RNA, 22 nt, Artificial Sequence
  Targeting domain
aagguucaugagacuagagguc

SEQ ID NO: 2178 - RNA, 21 nt, Artificial Sequence
  Targeting domain
agguucaugagacuagagguc

SEQ ID NO: 2179 - RNA, 21 nt, Artificial Sequence
  Targeting domain
aaacaggagauacucaacaca

SEQ ID NO: 2180 - skipped

SEQ ID NO: 2181 - RNA, 19 nt, Artificial Sequence
  Targeting domain
acaggagauacucaacaca

SEQ ID NO: 2182 - RNA, 23 nt, Artificial Sequence
  Targeting domain
agcacguacaaaagaacauacau

SEQ ID NO: 2183 - skipped

SEQ ID NO: 2184 - RNA, 19 nt, Artificial Sequence
  Targeting domain
aguaaggaggauguaagac

SEQ ID NO: 2185 - RNA, 21 nt, Artificial Sequence
  Targeting domain
agcuuuugacaguuuuuaagg

SEQ ID NO: 2186 - RNA, 24 nt, Artificial Sequence
  Targeting domain
aaauucacugagcaaaacaacugg

SEQ ID NO: 2187 - RNA, 23 nt, Artificial Sequence
  Targeting domain
aauucacugagcaaaacaacugg

SEQ ID NO: 2188 - RNA, 22 nt, Artificial Sequence
  Targeting domain
auucacugagcaaaacaacugg

SEQ ID NO: 2189 - RNA, 18 nt, Artificial Sequence
  Targeting domain
acugagcaaaacaacugg

SEQ ID NO: 2190 - skipped

SEQ ID NO: 2191 - RNA, 19 nt, Artificial Sequence
  Targeting domain
acaaguuuugaaacaggaa

SEQ ID NO: 2192 - RNA, 22 nt, Artificial Sequence
  Targeting domain
aaugccugaacaaguuuugaaa

SEQ ID NO: 2193 - RNA, 21 nt, Artificial Sequence
  Targeting domain
augccugaacaaguuuugaaa

SEQ ID NO: 2194 - RNA, 24 nt, Artificial Sequence
  Targeting domain
auucacugagcaaaacaacuggaa

SEQ ID NO: 2195 - skipped

SEQ ID NO: 2196 - RNA, 24 nt, Artificial Sequence
  Targeting domain
aaaaagguaaugccugaacaaguu

SEQ ID NO: 2197 - RNA, 23 nt, Artificial Sequence
  Targeting domain
aaaagguaaugccugaacaaguu

SEQ ID NO: 2198 - RNA, 22 nt, Artificial Sequence
  Targeting domain
aaagguaaugccugaacaaguu

SEQ ID NO: 2199 - RNA, 21 nt, Artificial Sequence
  Targeting domain
aagguaaugccugaacaaguu

SEQ ID NO: 2200 - skipped

SEQ ID NO: 2201 - RNA, 19 nt, Artificial Sequence
  Targeting domain
acgugcucuuuucuauaua

SEQ ID NO: 2202 - RNA, 23 nt, Artificial Sequence
  Targeting domain
auuaucuauuccauucuucacac

SEQ ID NO: 2203 - RNA, 20 nt, Artificial Sequence
  Targeting domain
aucuauuccauucuucacac

SEQ ID NO: 2204 - RNA, 24 nt, Artificial Sequence
  Targeting domain
aagagagaaaugguucccuauaua

SEQ ID NO: 2205 - RNA, 23 nt, Artificial Sequence
  Targeting domain
agagagaaaugguucccuauaua

SEQ ID NO: 2206 - RNA, 21 nt, Artificial Sequence
  Targeting domain
agagaaaugguucccuauaua

SEQ ID NO: 2207 - RNA, 19 nt, Artificial Sequence
  Targeting domain
agaaaugguucccuauaua

SEQ ID NO: 2208 - RNA, 19 nt, Artificial Sequence
  Targeting domain
aggaaauuauuguugcuuu

SEQ ID NO: 2209 - RNA, 22 nt, Artificial Sequence
  Targeting domain
acugagcaaaacaacuggaaga

SEQ ID NO: 2210 - RNA, 18 nt, Artificial Sequence
  Targeting domain
agcaaaacaacuggaaga

SEQ ID NO: 2211 - RNA, 24 nt, Artificial Sequence
  Targeting domain
auacauaagaaagaacacuguggu

SEQ ID NO: 2212 - RNA, 22 nt, Artificial Sequence
  Targeting domain
acauaagaaagaacacuguggu

SEQ ID NO: 2213 - skipped

SEQ ID NO: 2214 - RNA, 18 nt, Artificial Sequence
  Targeting domain
aagaaagaacacuguggu

SEQ ID NO: 2215 - RNA, 18 nt, Artificial Sequence
  Targeting domain
aagaauggaauagauaau

SEQ ID NO: 2216 - RNA, 22 nt, Artificial Sequence
  Targeting domain
aaggaggauguaagacuggaga

SEQ ID NO: 2217 - RNA, 21 nt, Artificial Sequence
  Targeting domain
aggaggauguaagacuggaga

SEQ ID NO: 2218 - RNA, 18 nt, Artificial Sequence
  Targeting domain
aggauguaagacuggaga

SEQ ID NO: 2219 - RNA, 23 nt, Artificial Sequence
  Targeting domain
aaaaacuugaaauuugauaguag

SEQ ID NO: 2220 - RNA, 22 nt, Artificial Sequence
  Targeting domain
aaaacuugaaauuugauaguag

SEQ ID NO: 2221 - RNA, 21 nt, Artificial Sequence
  Targeting domain
aaacuugaaauuugauaguag

SEQ ID NO: 2222 - RNA, 20 nt, Artificial Sequence
  Targeting domain
aacuugaaauuugauaguag

SEQ ID NO: 2223 - RNA, 19 nt, Artificial Sequence
  Targeting domain
acuugaaauuugauaguag

SEQ ID NO: 2224 - RNA, 18 nt, Artificial Sequence
  Targeting domain
acauaucugucuuccuua

SEQ ID NO: 2225 - RNA, 18 nt, Artificial Sequence
  CEP290-1418 targeting domain (RNA)
auuaaaaaaaguaugcuu

SEQ ID NO: 2226 - RNA, 24 nt, Artificial Sequence
  Targeting domain
auaucaaaagacuuauauuccauu

SEQ ID NO: 2227 - RNA, 22 nt, Artificial Sequence
  Targeting domain
aucaaaagacuuauauuccauu

SEQ ID NO: 2228 - RNA, 19 nt, Artificial Sequence
  Targeting domain
aaaagacuuauauuccauu

SEQ ID NO: 2229 - RNA, 18 nt, Artificial Sequence
  Targeting domain
aaagacuuauauuccauu

SEQ ID NO: 2230 - RNA, 24 nt, Artificial Sequence
  Targeting domain
aaaaucagauuucaugugugaaga

SEQ ID NO: 2231 - RNA, 23 nt, Artificial Sequence
  Targeting domain
aaaucagauuucaugugugaaga

SEQ ID NO: 2232 - RNA, 22 nt, Artificial Sequence
  Targeting domain
aaucagauuucaugugugaaga

SEQ ID NO: 2233 - RNA, 21 nt, Artificial Sequence
  Targeting domain
aucagauuucaugugugaaga

SEQ ID NO: 2234 - RNA, 18 nt, Artificial Sequence
  Targeting domain
agauuucaugugugaaga

SEQ ID NO: 2235 - RNA, 24 nt, Artificial Sequence
  Targeting domain
aauggaauauaagucuuuugauau

SEQ ID NO: 2236 - RNA, 23 nt, Artificial Sequence
  Targeting domain
auggaauauaagucuuuugauau

SEQ ID NO: 2237 - RNA, 19 nt, Artificial Sequence
  Targeting domain
aauauaagucuuuugauau

SEQ ID NO: 2238 - RNA, 18 nt, Artificial Sequence
  Targeting domain
auauaagucuuuugauau

SEQ ID NO: 2239 - RNA, 19 nt, Artificial Sequence
  Targeting domain
aagaauggaauagauaaua

SEQ ID NO: 2240 - RNA, 18 nt, Artificial Sequence
  Targeting domain
agaauggaauagauaaua

SEQ ID NO: 2241 - RNA, 24 nt, Artificial Sequence
  Targeting domain
aaaacuggauggguaauaaagcaa

SEQ ID NO: 2242 - RNA, 23 nt, Artificial Sequence
  Targeting domain
aaacuggauggguaauaaagcaa

SEQ ID NO: 2243 - RNA, 22 nt, Artificial Sequence
  Targeting domain
aacuggauggguaauaaagcaa

SEQ ID NO: 2244 - RNA, 21 nt, Artificial Sequence
  Targeting domain
acuggauggguaauaaagcaa

SEQ ID NO: 2245 - RNA, 24 nt, Artificial Sequence
  Targeting domain
auagaaauucacugagcaaaacaa

SEQ ID NO: 2246 - RNA, 22 nt, Artificial Sequence
  Targeting domain
agaaauucacugagcaaaacaa

SEQ ID NO: 2247 - skipped

SEQ ID NO: 2248 - RNA, 19 nt, Artificial Sequence
  Targeting domain
aauucacugagcaaaacaa

SEQ ID NO: 2249 - RNA, 18 nt, Artificial Sequence
  Targeting domain
auucacugagcaaaacaa

SEQ ID NO: 2250 - RNA, 24 nt, Artificial Sequence
  Targeting domain
aggauguaagacuggagauagaga

SEQ ID NO: 2251 - RNA, 21 nt, Artificial Sequence
  Targeting domain
auguaagacuggagauagaga

SEQ ID NO: 2252 - RNA, 21 nt, Artificial Sequence
  Targeting domain
aaauuugauaguagaagaaaa

SEQ ID NO: 2253 - RNA, 20 nt, Artificial Sequence
  Targeting domain
aauuugauaguagaagaaaa

SEQ ID NO: 2254 - RNA, 19 nt, Artificial Sequence
  Targeting domain
auuugauaguagaagaaaa

SEQ ID NO: 2255-2260 - skipped (6 entries)

SEQ ID NO: 2261 - RNA, 19 nt, Artificial Sequence
  Targeting domain
aauaaagcaaaagaaaaac

SEQ ID NO: 2262 - RNA, 18 nt, Artificial Sequence
  Targeting domain
auaaagcaaaagaaaaac

SEQ ID NO: 2263 - RNA, 24 nt, Artificial Sequence
  Targeting domain
auucuuuuuuuguuguuuuuuuuu

SEQ ID NO: 2264 - RNA, 20 nt, Artificial Sequence
  Targeting domain
acuccagccugggcaacaca

SEQ ID NO: 2265 - RNA, 22 nt, Artificial Sequence
  Targeting domain
cuuaccucaugucaucuagagc

SEQ ID NO: 2266 - RNA, 18 nt, Artificial Sequence
  Targeting domain
ccucaugucaucuagagc

SEQ ID NO: 2267 - RNA, 23 nt, Artificial Sequence
  Targeting domain
caguuuuuaaggcggggagucac

SEQ ID NO: 2268 - skipped

SEQ ID NO: 2269 - RNA, 18 nt, Artificial Sequence
  Targeting domain
cagaguucaagcuaauac

SEQ ID NO: 2270 - RNA, 19 nt, Artificial Sequence
  Targeting domain
cuugaacucugugccaaac

SEQ ID NO: 2271 - RNA, 23 nt, Artificial Sequence
  Targeting domain
cauguggugucaaauauggugcu

SEQ ID NO: 2272 - RNA, 24 nt, Artificial Sequence
  Targeting domain
cauguggugucaaauauggugcuu

SEQ ID NO: 2273 - RNA, 22 nt, Artificial Sequence
  Targeting domain
cucuagaugacaugagguaagu

SEQ ID NO: 2274 - skipped

SEQ ID NO: 2275 - RNA, 24 nt, Artificial Sequence
  Targeting domain
cuaauacaugagagugauuagugg

SEQ ID NO: 2276 - RNA, 18 nt, Artificial Sequence
  Targeting domain
caugagagugauuagugg

SEQ ID NO: 2277 - skipped

SEQ ID NO: 2278 - RNA, 23 nt, Artificial Sequence
  Targeting domain
ccaaacaggagauacucaacaca

SEQ ID NO: 2279 - RNA, 22 nt, Artificial Sequence
  Targeting domain
caaacaggagauacucaacaca

SEQ ID NO: 2280 - RNA, 18 nt, Artificial Sequence
  Targeting domain
caggagauacucaacaca

SEQ ID NO: 2281 - RNA, 21 nt, Artificial Sequence
  Targeting domain
cacguacaaaagaacauacau

SEQ ID NO: 2282 - RNA, 19 nt, Artificial Sequence
  Targeting domain
cguacaaaagaacauacau

SEQ ID NO: 2283 - skipped

SEQ ID NO: 2284 - RNA, 19 nt, Artificial Sequence
  Targeting domain
cuuuugacaguuuuuaagg

SEQ ID NO: 2285 - RNA, 19 nt, Artificial Sequence
  Targeting domain
cgugcucuuuucuauauau

SEQ ID NO: 2286 - RNA, 19 nt, Artificial Sequence
  Targeting domain
cacugagcaaaacaacugg

SEQ ID NO: 2287 - RNA, 24 nt, Artificial Sequence
  Targeting domain
ccugaacaaguuuugaaacaggaa

SEQ ID NO: 2288 - RNA, 23 nt, Artificial Sequence
  Targeting domain
cugaacaaguuuugaaacaggaa

SEQ ID NO: 2289 - RNA, 18 nt, Artificial Sequence
  Targeting domain
caaguuuugaaacaggaa

SEQ ID NO: 2290 - RNA, 18 nt, Artificial Sequence
  Targeting domain
ccugaacaaguuuugaaa

SEQ ID NO: 2291 - RNA, 21 nt, Artificial Sequence
  Targeting domain
cacugagcaaaacaacuggaa

SEQ ID NO: 2292 - RNA, 19 nt, Artificial Sequence
  Targeting domain
cugagcaaaacaacuggaa

SEQ ID NO: 2293 - RNA, 18 nt, Artificial Sequence
  Targeting domain
cgugcucuuuucuauaua

SEQ ID NO: 2294 - RNA, 18 nt, Artificial Sequence
  Targeting domain
cuauuccauucuucacac

SEQ ID NO: 2295 - RNA, 22 nt, Artificial Sequence
  Targeting domain
cuuaggaaauuauuguugcuuu

SEQ ID NO: 2296 - RNA, 21 nt, Artificial Sequence
  CEP290-1488 targeting domain (RNA)
cuuuuugagagguaaagguuc

SEQ ID NO: 2297 - RNA, 23 nt, Artificial Sequence
  Targeting domain
cacugagcaaaacaacuggaaga

SEQ ID NO: 2298 - RNA, 21 nt, Artificial Sequence
  Targeting domain
cugagcaaaacaacuggaaga

SEQ ID NO: 2299 - RNA, 21 nt, Artificial Sequence
  Targeting domain
cauaagaaagaacacuguggu

SEQ ID NO: 2300 - RNA, 18 nt, Artificial Sequence
  CEP290-1492 targeting domain (RNA)
cuugaaauuugauaguag

SEQ ID NO: 2301 - skipped

SEQ ID NO: 2302 - RNA, 19 nt, Artificial Sequence
  Targeting domain
cauuaaaaaaaguaugcuu

SEQ ID NO: 2303 - skipped

SEQ ID NO: 2304 - RNA, 19 nt, Artificial Sequence
  Targeting domain
cagauuucaugugugaaga

SEQ ID NO: 2305 - RNA, 20 nt, Artificial Sequence
  Targeting domain
cuggauggguaauaaagcaa

SEQ ID NO: 2306 - RNA, 19 nt, Artificial Sequence
  Targeting domain
cuuaagcauacuuuuuuua

SEQ ID NO: 2307 - RNA, 21 nt, Artificial Sequence
  Targeting domain
cuuuuuuuguuguuuuuuuuu

SEQ ID NO: 2308 - RNA, 24 nt, Artificial Sequence
  Targeting domain
cugcacuccagccugggcaacaca

SEQ ID NO: 2309 - RNA, 21 nt, Artificial Sequence
  Targeting domain
cacuccagccugggcaacaca

SEQ ID NO: 2310 - RNA, 19 nt, Artificial Sequence
  Targeting domain
cuccagccugggcaacaca

SEQ ID NO: 2311 - RNA, 21 nt, Artificial Sequence
  Targeting domain
guuuuuaaggcggggagucac

SEQ ID NO: 2312 - RNA, 22 nt, Artificial Sequence
  CEP290-232 targeting domain (RNA)
ggcacagaguucaagcuaauac

SEQ ID NO: 2313 - RNA, 21 nt, Artificial Sequence
  Targeting domain
gcacagaguucaagcuaauac

SEQ ID NO: 2314 - RNA, 24 nt, Artificial Sequence
  Targeting domain
gcauguggugucaaauauggugcu

SEQ ID NO: 2315 - skipped

SEQ ID NO: 2316 - RNA, 18 nt, Artificial Sequence
  Targeting domain
ggugucaaauauggugcu

SEQ ID NO: 2317 - RNA, 21 nt, Artificial Sequence
  Targeting domain
guggugucaaauauggugcuu

SEQ ID NO: 2318 - RNA, 19 nt, Artificial Sequence
  Targeting domain
ggugucaaauauggugcuu

SEQ ID NO: 2319 - RNA, 18 nt, Artificial Sequence
  Targeting domain
gugucaaauauggugcuu

SEQ ID NO: 2320 - RNA, 23 nt, Artificial Sequence
  Targeting domain
gcucuagaugacaugagguaagu

SEQ ID NO: 2321 - skipped

SEQ ID NO: 2322 - RNA, 20 nt, Artificial Sequence
  Targeting domain
gguucaugagacuagagguc

SEQ ID NO: 2323 - RNA, 19 nt, Artificial Sequence
  Targeting domain
guucaugagacuagagguc

SEQ ID NO: 2324 - RNA, 24 nt, Artificial Sequence
  Targeting domain
gccaaacaggagauacucaacaca

SEQ ID NO: 2325 - RNA, 24 nt, Artificial Sequence
  Targeting domain
gagcacguacaaaagaacauacau

SEQ ID NO: 2326 - RNA, 22 nt, Artificial Sequence
  Targeting domain
gcacguacaaaagaacauacau

SEQ ID NO: 2327 - RNA, 18 nt, Artificial Sequence
  Targeting domain
guacaaaagaacauacau

SEQ ID NO: 2328 - RNA, 24 nt, Artificial Sequence
  Targeting domain
guggcaguaaggaggauguaagac

SEQ ID NO: 2329 - RNA, 22 nt, Artificial Sequence
  Targeting domain
ggcaguaaggaggauguaagac

SEQ ID NO: 2330 - RNA, 21 nt, Artificial Sequence
  Targeting domain
gcaguaaggaggauguaagac

SEQ ID NO: 2331 - RNA, 18 nt, Artificial Sequence
  Targeting domain
guaaggaggauguaagac

SEQ ID NO: 2332 - RNA, 24 nt, Artificial Sequence
  Targeting domain
gguagcuuuugacaguuuuuaagg

SEQ ID NO: 2333 - RNA, 23 nt, Artificial Sequence
  Targeting domain
guagcuuuugacaguuuuuaagg

SEQ ID NO: 2334 - RNA, 22 nt, Artificial Sequence
  Targeting domain
guacgugcucuuuucuauauau

SEQ ID NO: 2335 - RNA, 18 nt, Artificial Sequence
  Targeting domain
gugcucuuuucuauauau

SEQ ID NO: 2336 - RNA, 21 nt, Artificial Sequence
  Targeting domain
gaacaaguuuugaaacaggaa

SEQ ID NO: 2337 - RNA, 24 nt, Artificial Sequence
  Targeting domain
guaaugccugaacaaguuuugaaa

SEQ ID NO: 2338 - RNA, 19 nt, Artificial Sequence
  Targeting domain
gccugaacaaguuuugaaa

SEQ ID NO: 2339 - RNA, 19 nt, Artificial Sequence
  Targeting domain
gguaaugccugaacaaguu

SEQ ID NO: 2340 - RNA, 18 nt, Artificial Sequence
  Targeting domain
guaaugccugaacaaguu

SEQ ID NO: 2341 - RNA, 21 nt, Artificial Sequence
  Targeting domain
guacgugcucuuuucuauaua

SEQ ID NO: 2342 - RNA, 22 nt, Artificial Sequence
  Targeting domain
gagagaaaugguucccuauaua

SEQ ID NO: 2343 - skipped

SEQ ID NO: 2344 - RNA, 18 nt, Artificial Sequence
  Targeting domain
gaaaugguucccuauaua

SEQ ID NO: 2345 - RNA, 23 nt, Artificial Sequence
  Targeting domain
gcuuaggaaauuauuguugcuuu

SEQ ID NO: 2346 - RNA, 18 nt, Artificial Sequence
  Targeting domain
ggaaauuauuguugcuuu

SEQ ID NO: 2347 - RNA, 22 nt, Artificial Sequence
  Targeting domain
gcuuuuugagagguaaagguuc

SEQ ID NO: 2348 - RNA, 19 nt, Artificial Sequence
  Targeting domain
gagcaaaacaacuggaaga

SEQ ID NO: 2349 - RNA, 23 nt, Artificial Sequence
  Targeting domain
gugugaagaauggaauagauaau

SEQ ID NO: 2350 - RNA, 21 nt, Artificial Sequence
  Targeting domain
gugaagaauggaauagauaau

SEQ ID NO: 2351 - RNA, 19 nt, Artificial Sequence
  Targeting domain
gaagaauggaauagauaau

SEQ ID NO: 2352 - RNA, 24 nt, Artificial Sequence
  Targeting domain
guaaggaggauguaagacuggaga

SEQ ID NO: 2353 - skipped

SEQ ID NO: 2354 - RNA, 19 nt, Artificial Sequence
  Targeting domain
gaggauguaagacuggaga

SEQ ID NO: 2355 - RNA, 24 nt, Artificial Sequence
  Targeting domain
gaaaaacuugaaauuugauaguag

SEQ ID NO: 2356 - RNA, 24 nt, Artificial Sequence
  Targeting domain
guguuuacauaucugucuuccuua

SEQ ID NO: 2357 - RNA, 22 nt, Artificial Sequence
  Targeting domain
guuuacauaucugucuuccuua

SEQ ID NO: 2358 - RNA, 23 nt, Artificial Sequence
  Targeting domain
guuccauuaaaaaaaguaugcuu

SEQ ID NO: 2359 - RNA, 21 nt, Artificial Sequence
  Targeting domain
ggaauauaagucuuuugauau

SEQ ID NO: 2360 - skipped

SEQ ID NO: 2361 - RNA, 24 nt, Artificial Sequence
  Targeting domain
gugugaagaauggaauagauaaua

SEQ ID NO: 2362 - RNA, 22 nt, Artificial Sequence
  Targeting domain
gugaagaauggaauagauaaua

SEQ ID NO: 2363 - RNA, 18 nt, Artificial Sequence
  Targeting domain
ggauggguaauaaagcaa

SEQ ID NO: 2364 - RNA, 21 nt, Artificial Sequence
  Targeting domain
gaaauucacugagcaaaacaa

SEQ ID NO: 2365 - RNA, 23 nt, Artificial Sequence
  CEP290-1557 targeting domain (RNA)
ggauguaagacuggagauagaga

SEQ ID NO: 2366 - RNA, 22 nt, Artificial Sequence
  CEP290-1558 targeting domain (RNA)
gauguaagacuggagauagaga

SEQ ID NO: 2367 - RNA, 19 nt, Artificial Sequence
  CEP290-1559 targeting domain (RNA)
guaagacuggagauagaga

SEQ ID NO: 2368 - RNA, 22 nt, Artificial Sequence
  CEP290-1560 targeting domain
gaaauuugauaguagaagaaaa

SEQ ID NO: 2369 - RNA, 23 nt, Artificial Sequence
  CEP290-1561 targeting domain
ggguaauaaagcaaaagaaaaac

SEQ ID NO: 2370 - RNA, 22 nt, Artificial Sequence
  CEP290-1562 targeting domain (RNA)
gguaauaaagcaaaagaaaaac

SEQ ID NO: 2371 - RNA, 21 nt, Artificial Sequence
  Targeting domain
guaauaaagcaaaagaaaaac

SEQ ID NO: 2372 - RNA, 22 nt, Artificial Sequence
  Targeting domain
gcacuccagccugggcaacaca

SEQ ID NO: 2373 - RNA, 24 nt, Artificial Sequence
  CEP290-1565 targeting domain
uacuuaccucaugucaucuagagc

SEQ ID NO: 2374 - RNA, 21 nt, Artificial Sequence
  Targeting domain
uuaccucaugucaucuagagc

SEQ ID NO: 2375-2376 - skipped (2 entries)

SEQ ID NO: 2377 - RNA, 19 nt, Artificial Sequence
  Targeting domain
uuuuaaggcggggagucac

SEQ ID NO: 2378 - RNA, 18 nt, Artificial Sequence
  Targeting domain
uuuaaggcggggagucac

SEQ ID NO: 2379 - RNA, 24 nt, Artificial Sequence
  Targeting domain
uuggcacagaguucaagcuaauac

SEQ ID NO: 2380 - RNA, 23 nt, Artificial Sequence
  Targeting domain
uggcacagaguucaagcuaauac

SEQ ID NO: 2381 - RNA, 23 nt, Artificial Sequence
  Targeting domain
uuagcuugaacucugugccaaac

SEQ ID NO: 2382 - RNA, 22 nt, Artificial Sequence
  Targeting domain
uagcuugaacucugugccaaac

SEQ ID NO: 2383 - RNA, 18 nt, Artificial Sequence
  Targeting domain
uugaacucugugccaaac

SEQ ID NO: 2384 - RNA, 21 nt, Artificial Sequence
  CEP290-1576 targeting domain
uguggugucaaauauggugcu

SEQ ID NO: 2385 - RNA, 19 nt, Artificial Sequence
  Targeting domain
uggugucaaauauggugcu

SEQ ID NO: 2386 - RNA, 22 nt, Artificial Sequence
  Targeting domain
uguggugucaaauauggugcuu

SEQ ID NO: 2387 - skipped

SEQ ID NO: 2388 - RNA, 24 nt, Artificial Sequence
  Targeting domain
ugcucuagaugacaugagguaagu

SEQ ID NO: 2389 - RNA, 21 nt, Artificial Sequence
  Targeting domain
ucuagaugacaugagguaagu

SEQ ID NO: 2390 - RNA, 19 nt, Artificial Sequence
  Targeting domain
uagaugacaugagguaagu

SEQ ID NO: 2391 - RNA, 23 nt, Artificial Sequence
  Targeting domain
uaauacaugagagugauuagugg

SEQ ID NO: 2392 - RNA, 24 nt, Artificial Sequence
  Targeting domain
uaaagguucaugagacuagagguc

SEQ ID NO: 2393 - RNA, 18 nt, Artificial Sequence
  Targeting domain
uucaugagacuagagguc

SEQ ID NO: 2394 - RNA, 23 nt, Artificial Sequence
  Targeting domain
uggcaguaaggaggauguaagac

SEQ ID NO: 2395 - RNA, 22 nt, Artificial Sequence
  Targeting domain
uagcuuuugacaguuuuuaagg

SEQ ID NO: 2396 - RNA, 18 nt, Artificial Sequence
  Targeting domain
uuuugacaguuuuuaagg

SEQ ID NO: 2397 - RNA, 24 nt, Artificial Sequence
  Targeting domain
uuguacgugcucuuuucuauauau

SEQ ID NO: 2398 - RNA, 23 nt, Artificial Sequence
  Targeting domain
uguacgugcucuuuucuauauau

SEQ ID NO: 2399 - RNA, 21 nt, Artificial Sequence
  CEP290-1592 targeting domain
uacgugcucuuuucuauauau

SEQ ID NO: 2400 - RNA, 21 nt, Artificial Sequence
  Targeting domain
uucacugagcaaaacaacugg

SEQ ID NO: 2401 - skipped

SEQ ID NO: 2402 - RNA, 22 nt, Artificial Sequence
  Targeting domain
ugaacaaguuuugaaacaggaa

SEQ ID NO: 2403 - RNA, 23 nt, Artificial Sequence
  Targeting domain
uaaugccugaacaaguuuugaaa

SEQ ID NO: 2404 - skipped

SEQ ID NO: 2405 - RNA, 23 nt, Artificial Sequence
  Targeting domain
uucacugagcaaaacaacuggaa

SEQ ID NO: 2406 - RNA, 22 nt, Artificial Sequence
  Targeting domain
ucacugagcaaaacaacuggaa

SEQ ID NO: 2407 - RNA, 18 nt, Artificial Sequence
  Targeting domain
ugagcaaaacaacuggaa

SEQ ID NO: 2408 - RNA, 24 nt, Artificial Sequence
  CEP290-1601 targeting domain
uuuguacgugcucuuuucuauaua

SEQ ID NO: 2409 - RNA, 23 nt, Artificial Sequence
  Targeting domain
uuguacgugcucuuuucuauaua

SEQ ID NO: 2410 - RNA, 22 nt, Artificial Sequence
  Targeting domain
uguacgugcucuuuucuauaua

SEQ ID NO: 2411 - skipped

SEQ ID NO: 2412 - RNA, 24 nt, Artificial Sequence
  Targeting domain
uauuaucuauuccauucuucacac

SEQ ID NO: 2413 - RNA, 22 nt, Artificial Sequence
  Targeting domain
uuaucuauuccauucuucacac

SEQ ID NO: 2414 - RNA, 21 nt, Artificial Sequence
  Targeting domain
uaucuauuccauucuucacac

SEQ ID NO: 2415 - RNA, 19 nt, Artificial Sequence
  Targeting domain
ucuauuccauucuucacac

SEQ ID NO: 2416 - RNA, 24 nt, Artificial Sequence
  Targeting domain
ugcuuaggaaauuauuguugcuuu

SEQ ID NO: 2417 - RNA, 21 nt, Artificial Sequence
  Targeting domain
uuaggaaauuauuguugcuuu

SEQ ID NO: 2418 - RNA, 20 nt, Artificial Sequence
  Targeting domain
uaggaaauuauuguugcuuu

SEQ ID NO: 2419 - RNA, 24 nt, Artificial Sequence
  Targeting domain
uugcuuuuugagagguaaagguuc

SEQ ID NO: 2420 - RNA, 23 nt, Artificial Sequence
  Targeting domain
ugcuuuuugagagguaaagguuc

SEQ ID NO: 2421 - RNA, 20 nt, Artificial Sequence
  Targeting domain
uuuuugagagguaaagguuc

SEQ ID NO: 2422 - RNA, 19 nt, Artificial Sequence
  Targeting domain
uuuugagagguaaagguuc

SEQ ID NO: 2423 - RNA, 18 nt, Artificial Sequence
  Targeting domain
uuugagagguaaagguuc

SEQ ID NO: 2424 - RNA, 24 nt, Artificial Sequence
  Targeting domain
ucacugagcaaaacaacuggaaga

SEQ ID NO: 2425 - skipped

SEQ ID NO: 2426 - RNA, 23 nt, Artificial Sequence
  Targeting domain
uacauaagaaagaacacuguggu

SEQ ID NO: 2427 - RNA, 19 nt, Artificial Sequence
  Targeting domain
uaagaaagaacacuguggu

SEQ ID NO: 2428 - RNA, 24 nt, Artificial Sequence
  Targeting domain
ugugugaagaauggaauagauaau

SEQ ID NO: 2429 - RNA, 22 nt, Artificial Sequence
  Targeting domain
ugugaagaauggaauagauaau

SEQ ID NO: 2430 - RNA, 20 nt, Artificial Sequence
  Targeting domain
ugaagaauggaauagauaau

SEQ ID NO: 2431 - RNA, 23 nt, Artificial Sequence
  Targeting domain
uaaggaggauguaagacuggaga

SEQ ID NO: 2432 - RNA, 23 nt, Artificial Sequence
  Targeting domain
uguuuacauaucugucuuccuua

SEQ ID NO: 2433 - RNA, 21 nt, Artificial Sequence
  Targeting domain
uuuacauaucugucuuccuua

SEQ ID NO: 2434 - skipped

SEQ ID NO: 2435 - RNA, 19 nt, Artificial Sequence
  Targeting domain
uacauaucugucuuccuua

SEQ ID NO: 2436 - RNA, 24 nt, Artificial Sequence
  Targeting domain
uguuccauuaaaaaaaguaugcuu

SEQ ID NO: 2437 - RNA, 22 nt, Artificial Sequence
  Targeting domain
uuccauuaaaaaaaguaugcuu

SEQ ID NO: 2438 - RNA, 21 nt, Artificial Sequence
  Targeting domain
uccauuaaaaaaaguaugcuu

SEQ ID NO: 2439 - RNA, 23 nt, Artificial Sequence
  CEP290-1632 targeting domain (RNA)
uaucaaaagacuuauauuccauu

SEQ ID NO: 2440 - RNA, 21 nt, Artificial Sequence
  Targeting domain
ucaaaagacuuauauuccauu

SEQ ID NO: 2441 - RNA, 20 nt, Artificial Sequence
  Targeting domain
ucagauuucaugugugaaga

SEQ ID NO: 2442 - RNA, 22 nt, Artificial Sequence
  Targeting domain
uggaauauaagucuuuugauau

SEQ ID NO: 2443 - RNA, 23 nt, Artificial Sequence
  Targeting domain
ugugaagaauggaauagauaaua

SEQ ID NO: 2444 - RNA, 21 nt, Artificial Sequence
  Targeting domain
ugaagaauggaauagauaaua

SEQ ID NO: 2445 - RNA, 19 nt, Artificial Sequence
  Targeting domain
uggauggguaauaaagcaa

SEQ ID NO: 2446 - RNA, 23 nt, Artificial Sequence
  CEP290-1639 targeting domain (RNA)
uagaaauucacugagcaaaacaa

SEQ ID NO: 2447 - skipped

SEQ ID NO: 2448 - RNA, 18 nt, Artificial Sequence
  CEP290-1641 targeting domain (RNA)
uaagacuggagauagaga

SEQ ID NO: 2449 - RNA, 24 nt, Artificial Sequence
  Targeting domain
uugaaauuugauaguagaagaaaa

SEQ ID NO: 2450 - RNA, 23 nt, Artificial Sequence
  Targeting domain
ugaaauuugauaguagaagaaaa

SEQ ID NO: 2451 - RNA, 18 nt, Artificial Sequence
  Targeting domain
uuugauaguagaagaaaa

SEQ ID NO: 2452 - skipped

SEQ ID NO: 2453 - RNA, 24 nt, Artificial Sequence
  CEP290-1646 targeting domain (RNA)
uuuuucuuaagcauacuuuuuuua

SEQ ID NO: 2454 - RNA, 23 nt, Artificial Sequence
  Targeting domain
uuuucuuaagcauacuuuuuuua

SEQ ID NO: 2455 - RNA, 22 nt, Artificial Sequence
  Targeting domain
uuucuuaagcauacuuuuuuua

SEQ ID NO: 2456 - RNA, 21 nt, Artificial Sequence
  Targeting domain
uucuuaagcauacuuuuuuua

SEQ ID NO: 2457 - skipped

SEQ ID NO: 2458 - RNA, 18 nt, Artificial Sequence
  Targeting domain
uuaagcauacuuuuuuua

SEQ ID NO: 2459 - RNA, 24 nt, Artificial Sequence
  Targeting domain
uggguaauaaagcaaaagaaaaac

SEQ ID NO: 2460 - RNA, 20 nt, Artificial Sequence
  CEP290-1653 targeting domain (RNA)
uaauaaagcaaaagaaaaac

SEQ ID NO: 2461 - RNA, 23 nt, Artificial Sequence
  Targeting domain
uucuuuuuuuguuguuuuuuuuu

SEQ ID NO: 2462 - RNA, 22 nt, Artificial Sequence
  Targeting domain
ucuuuuuuuguuguuuuuuuuu

SEQ ID NO: 2463 - RNA, 20 nt, Artificial Sequence
  Targeting domain
uuuuuuuguuguuuuuuuuu

SEQ ID NO: 2464 - RNA, 19 nt, Artificial Sequence
  Targeting domain
uuuuuuguuguuuuuuuuu

SEQ ID NO: 2465 - RNA, 18 nt, Artificial Sequence
  CEP290-1658 targeting domain (RNA)
uuuuuguuguuuuuuuuu

SEQ ID NO: 2466 - RNA, 23 nt, Artificial Sequence
  Targeting domain
ugcacuccagccugggcaacaca

SEQ ID NO: 2467 - RNA, 18 nt, Artificial Sequence
  Targeting domain
uccagccugggcaacaca

SEQ ID NO: 2468 - RNA, 21 nt, Artificial Sequence
  CEP290-1661 targeting domain (RNA)
auuuucgugaccucuagucuc

SEQ ID NO: 2469 - RNA, 23 nt, Artificial Sequence
  CEP290-1662 targeting domain (RNA)
acuaaucacucucauguauuagc

SEQ ID NO: 2470 - skipped

SEQ ID NO: 2471 - RNA, 19 nt, Artificial Sequence
  Targeting domain
aucacucucauguauuagc

SEQ ID NO: 2472 - RNA, 19 nt, Artificial Sequence
  Targeting domain
agaugacaugagguaagua

SEQ ID NO: 2473 - RNA, 24 nt, Artificial Sequence
  Targeting domain
accucaugucaucuagagcaagag

SEQ ID NO: 2474 - RNA, 19 nt, Artificial Sequence
  Targeting domain
augucaucuagagcaagag

SEQ ID NO: 2475 - RNA, 24 nt, Artificial Sequence
  CEP290-1668 targeting domain (RNA)
aauacaugagagugauuaguggug

SEQ ID NO: 2476 - RNA, 23 nt, Artificial Sequence
  CEP290-1669 targeting domain (RNA)
auacaugagagugauuaguggug

SEQ ID NO: 2477 - RNA, 21 nt, Artificial Sequence
  Targeting domain
acaugagagugauuaguggug

SEQ ID NO: 2478 - RNA, 19 nt, Artificial Sequence
  Targeting domain
augagagugauuaguggug

SEQ ID NO: 2479 - RNA, 21 nt, Artificial Sequence
  Targeting domain
acgugcucuuuucuauauaua

SEQ ID NO: 2480 - RNA, 21 nt, Artificial Sequence
  Targeting domain
acaaaaccuauguauaagaug

SEQ ID NO: 2481 - RNA, 19 nt, Artificial Sequence
  Targeting domain
aaaaccuauguauaagaug

SEQ ID NO: 2482 - RNA, 18 nt, Artificial Sequence
  Targeting domain
aaaccuauguauaagaug

SEQ ID NO: 2483 - RNA, 24 nt, Artificial Sequence
  Targeting domain
auauauagaaaagagcacguacaa

SEQ ID NO: 2484 - RNA, 22 nt, Artificial Sequence
  CEP290-1677 targeting domain (RNA)
auauagaaaagagcacguacaa

SEQ ID NO: 2485 - skipped

SEQ ID NO: 2486 - RNA, 18 nt, Artificial Sequence
  Targeting domain
agaaaagagcacguacaa

SEQ ID NO: 2487 - RNA, 24 nt, Artificial Sequence
  Targeting domain
agaaaugguucccuauauauagaa

SEQ ID NO: 2488 - RNA, 22 nt, Artificial Sequence
  Targeting domain
aaaugguucccuauauauagaa

SEQ ID NO: 2489 - RNA, 21 nt, Artificial Sequence
  Targeting domain
aaugguucccuauauauagaa

SEQ ID NO: 2490 - skipped

SEQ ID NO: 2491 - RNA, 24 nt, Artificial Sequence
  CEP290-1684 targeting domain (RNA)
auggaauauaagucuuuugauaua

SEQ ID NO: 2492 - skipped

SEQ ID NO: 2493 - RNA, 19 nt, Artificial Sequence
  CEP290-1686 targeting domain (RNA)
auauaagucuuuugauaua

SEQ ID NO: 2494 - RNA, 24 nt, Artificial Sequence
  CEP290-1687 targeting domain (RNA)
acguacaaaagaacauacauaaga

SEQ ID NO: 2495 - skipped

SEQ ID NO: 2496 - RNA, 18 nt, Artificial Sequence
  CEP290-1689 targeting domain (RNA)
aaaagaacauacauaaga

SEQ ID NO: 2497 - RNA, 19 nt, Artificial Sequence
  Targeting domain
aagaaaaaaaagguaaugc

SEQ ID NO: 2498 - RNA, 18 nt, Artificial Sequence
  Targeting domain
agaaaaaaaagguaaugc

SEQ ID NO: 2499 - RNA, 19 nt, Artificial Sequence
  Targeting domain
aaacaggaauagaaauuca

SEQ ID NO: 2500 - RNA, 18 nt, Artificial Sequence
  CEP290-1693 targeting domain (RNA)
aacaggaauagaaauuca

SEQ ID NO: 2501 - RNA, 24 nt, Artificial Sequence
  Targeting domain
aagaucacuccacugcacuccagc

SEQ ID NO: 2502 - RNA, 23 nt, Artificial Sequence
  Targeting domain
agaucacuccacugcacuccagc

SEQ ID NO: 2503 - RNA, 21 nt, Artificial Sequence
  Targeting domain
aucacuccacugcacuccagc

SEQ ID NO: 2504 - RNA, 18 nt, Artificial Sequence
  Targeting domain
acuccacugcacuccagc

SEQ ID NO: 2505 - RNA, 22 nt, Artificial Sequence
  CEP290-1698 targeting domain (RNA)
ccccuacuuaccucaugucauc

SEQ ID NO: 2506 - RNA, 21 nt, Artificial Sequence
  Targeting domain
cccuacuuaccucaugucauc

SEQ ID NO: 2507 - skipped

SEQ ID NO: 2508 - RNA, 19 nt, Artificial Sequence
  CEP290-1701 targeting domain (RNA)
cuacuuaccucaugucauc

SEQ ID NO: 2509 - RNA, 24 nt, Artificial Sequence
  CEP290-1702 targeting domain (RNA)
cugauuuucgugaccucuagucuc

SEQ ID NO: 2510 - RNA, 24 nt, Artificial Sequence
  CEP290-1703 targeting domain (RNA)
cacuaaucacucucauguauuagc

SEQ ID NO: 2511 - RNA, 22 nt, Artificial Sequence
  CEP290-1704 targeting domain (RNA)
cuaaucacucucauguauuagc

SEQ ID NO: 2512 - RNA, 23 nt, Artificial Sequence
  Targeting domain
cucuagaugacaugagguaagua

SEQ ID NO: 2513 - RNA, 21 nt, Artificial Sequence
  CEP290-1706 targeting domain (RNA)
cuagaugacaugagguaagua

SEQ ID NO: 2514 - RNA, 23 nt, Artificial Sequence
  Targeting domain
ccucaugucaucuagagcaagag

SEQ ID NO: 2515 - RNA, 22 nt, Artificial Sequence
  Targeting domain
cucaugucaucuagagcaagag

SEQ ID NO: 2516-2519 - skipped (4 entries)

SEQ ID NO: 2520 - RNA, 23 nt, Artificial Sequence
  Targeting domain
cguacaaaagaacauacauaaga

SEQ ID NO: 2521 - RNA, 19 nt, Artificial Sequence
  Targeting domain
caaaagaacauacauaaga

SEQ ID NO: 2522 - RNA, 22 nt, Artificial Sequence
  Targeting domain
cuuaagaaaaaaaagguaaugc

SEQ ID NO: 2523 - skipped

SEQ ID NO: 2524 - RNA, 19 nt, Artificial Sequence
  Targeting domain
cacuccacugcacuccagc

SEQ ID NO: 2525 - RNA, 24 nt, Artificial Sequence
  CEP290-132 targeting domain (RNA)
guccccuacuuaccucaugucauc

SEQ ID NO: 2526 - RNA, 22 nt, Artificial Sequence
  Targeting domain
gauuuucgugaccucuagucuc

SEQ ID NO: 2527 - RNA, 24 nt, Artificial Sequence
  Targeting domain
gcucuagaugacaugagguaagua

SEQ ID NO: 2528 - RNA, 18 nt, Artificial Sequence
  Targeting domain
gaugacaugagguaagua

SEQ ID NO: 2529 - RNA, 23 nt, Artificial Sequence
  Targeting domain
guacgugcucuuuucuauauaua

SEQ ID NO: 2530 - RNA, 19 nt, Artificial Sequence
  Targeting domain
gugcucuuuucuauauaua

SEQ ID NO: 2531 - RNA, 23 nt, Artificial Sequence
  CEP290-1723 targeting domain (RNA)
guacaaaaccuauguauaagaug

SEQ ID NO: 2532 - RNA, 23 nt, Artificial Sequence
  Targeting domain
gaaaugguucccuauauauagaa

SEQ ID NO: 2533 - RNA, 18 nt, Artificial Sequence
  Targeting domain
gguucccuauauauagaa

SEQ ID NO: 2534 - RNA, 22 nt, Artificial Sequence
  Targeting domain
ggaauauaagucuuuugauaua

SEQ ID NO: 2535 - RNA, 21 nt, Artificial Sequence
  Targeting domain
gaauauaagucuuuugauaua

SEQ ID NO: 2536 - RNA, 22 nt, Artificial Sequence
  Targeting domain
guacaaaagaacauacauaaga

SEQ ID NO: 2537 - RNA, 23 nt, Artificial Sequence
  Targeting domain
gcuuaagaaaaaaaagguaaugc

SEQ ID NO: 2538 - skipped

SEQ ID NO: 2539 - RNA, 22 nt, Artificial Sequence
  Targeting domain
gaucacuccacugcacuccagc

SEQ ID NO: 2540 - RNA, 23 nt, Artificial Sequence
  Targeting domain
uccccuacuuaccucaugucauc

SEQ ID NO: 2541 - RNA, 18 nt, Artificial Sequence
  CEP290-1733 targeting domain (RNA)
uacuuaccucaugucauc

SEQ ID NO: 2542 - RNA, 23 nt, Artificial Sequence
  Targeting domain
ugauuuucgugaccucuagucuc

SEQ ID NO: 2543 - RNA, 20 nt, Artificial Sequence
  Targeting domain
uuuucgugaccucuagucuc

SEQ ID NO: 2544 - RNA, 19 nt, Artificial Sequence
  Targeting domain
uuucgugaccucuagucuc

SEQ ID NO: 2545 - RNA, 18 nt, Artificial Sequence
  Targeting domain
uucgugaccucuagucuc

SEQ ID NO: 2546 - RNA, 21 nt, Artificial Sequence
  Targeting domain
uaaucacucucauguauuagc

SEQ ID NO: 2547 - RNA, 18 nt, Artificial Sequence
  CEP290-1739 targeting domain (RNA)
ucacucucauguauuagc

SEQ ID NO: 2548 - RNA, 22 nt, Artificial Sequence
  Targeting domain
ucuagaugacaugagguaagua

SEQ ID NO: 2549 - skipped

SEQ ID NO: 2550 - RNA, 21 nt, Artificial Sequence
  Targeting domain
ucaugucaucuagagcaagag

SEQ ID NO: 2551 - RNA, 18 nt, Artificial Sequence
  Targeting domain
ugucaucuagagcaagag

SEQ ID NO: 2552 - RNA, 22 nt, Artificial Sequence
  Targeting domain
uacaugagagugauuaguggug

SEQ ID NO: 2553 - RNA, 18 nt, Artificial Sequence
  Targeting domain
ugagagugauuaguggug

SEQ ID NO: 2554 - RNA, 24 nt, Artificial Sequence
  Targeting domain
uguacgugcucuuuucuauauaua

SEQ ID NO: 2555 - RNA, 22 nt, Artificial Sequence
  Targeting domain
uacgugcucuuuucuauauaua

SEQ ID NO: 2556 - RNA, 18 nt, Artificial Sequence
  Targeting domain
ugcucuuuucuauauaua

SEQ ID NO: 2557 - RNA, 24 nt, Artificial Sequence
  Targeting domain
uguacaaaaccuauguauaagaug

SEQ ID NO: 2558 - RNA, 22 nt, Artificial Sequence
  CEP290-1750 targeting domain (RNA)
uacaaaaccuauguauaagaug

SEQ ID NO: 2559 - RNA, 23 nt, Artificial Sequence
  Targeting domain
uauauagaaaagagcacguacaa

SEQ ID NO: 2560 - RNA, 21 nt, Artificial Sequence
  Targeting domain
uauagaaaagagcacguacaa

SEQ ID NO: 2561 - RNA, 19 nt, Artificial Sequence
  Targeting domain
uagaaaagagcacguacaa

SEQ ID NO: 2562 - RNA, 19 nt, Artificial Sequence
  Targeting domain
ugguucccuauauauagaa

SEQ ID NO: 2563 - RNA, 23 nt, Artificial Sequence
  Targeting domain
uggaauauaagucuuuugauaua

SEQ ID NO: 2564 - RNA, 18 nt, Artificial Sequence
  Targeting domain
uauaagucuuuugauaua

SEQ ID NO: 2565 - RNA, 21 nt, Artificial Sequence
  Targeting domain
uacaaaagaacauacauaaga

SEQ ID NO: 2566 - RNA, 24 nt, Artificial Sequence
  CEP290-1758 targeting domain (RNA)
ugcuuaagaaaaaaaagguaaugc

SEQ ID NO: 2567 - RNA, 21 nt, Artificial Sequence
  Targeting domain
uuaagaaaaaaaagguaaugc

SEQ ID NO: 2568 - skipped

SEQ ID NO: 2569 - RNA, 24 nt, Artificial Sequence
  Targeting domain
uuuugaaacaggaauagaaauuca

SEQ ID NO: 2570 - RNA, 23 nt, Artificial Sequence
  Targeting domain
uuugaaacaggaauagaaauuca

SEQ ID NO: 2571 - RNA, 22 nt, Artificial Sequence
  Targeting domain
uugaaacaggaauagaaauuca

SEQ ID NO: 2572 - RNA, 21 nt, Artificial Sequence
  Targeting domain
ugaaacaggaauagaaauuca

SEQ ID NO: 2573 - RNA, 24 nt, Artificial Sequence
  Targeting domain
uuuucuuaagcauacuuuuuuuaa

SEQ ID NO: 2574 - RNA, 23 nt, Artificial Sequence
  Targeting domain
uuucuuaagcauacuuuuuuuaa

SEQ ID NO: 2575 - RNA, 22 nt, Artificial Sequence
  Targeting domain
uucuuaagcauacuuuuuuuaa

SEQ ID NO: 2576 - RNA, 21 nt, Artificial Sequence
  CEP290-1768 targeting domain (RNA)
ucuuaagcauacuuuuuuuaa

SEQ ID NO: 2577 - RNA, 19 nt, Artificial Sequence
  Targeting domain
uuaagcauacuuuuuuuaa

SEQ ID NO: 2578 - RNA, 18 nt, Artificial Sequence
  Targeting domain
uaagcauacuuuuuuuaa

SEQ ID NO: 2579 - RNA, 20 nt, Artificial Sequence
  Targeting domain
ucacuccacugcacuccagc

SEQ ID NO: 2580 - RNA, 23 nt, Artificial Sequence
  CEP290-1772 targeting domain (RNA)
aguuuuuaaggcggggagucaca

SEQ ID NO: 2581 - RNA, 24 nt, Artificial Sequence
  Targeting domain
aaacugucaaaagcuaccgguuac

SEQ ID NO: 2582 - RNA, 23 nt, Artificial Sequence
  CEP290-1774 targeting domain (RNA)
aacugucaaaagcuaccgguuac

SEQ ID NO: 2583 - RNA, 22 nt, Artificial Sequence
  CEP290-252 targeting domain (RNA)
acugucaaaagcuaccgguuac

SEQ ID NO: 2584 - RNA, 24 nt, Artificial Sequence
  Targeting domain
aguucaucucuugcucuagaugac

SEQ ID NO: 2585 - RNA, 19 nt, Artificial Sequence
  Targeting domain
aucucuugcucuagaugac

SEQ ID NO: 2586 - RNA, 20 nt, Artificial Sequence
  Targeting domain
acgaaaaucagauuucaugu

SEQ ID NO: 2587 - RNA, 21 nt, Artificial Sequence
  CEP290-1778 targeting domain (RNA)
aauacaugagagugauuagug

SEQ ID NO: 2588 - skipped

SEQ ID NO: 2589 - RNA, 18 nt, Artificial Sequence
  CEP290-1780 targeting domain (RNA)
acaugagagugauuagug

SEQ ID NO: 2590 - RNA, 23 nt, Artificial Sequence
  CEP290-1781 targeting domain (RNA)
auuagcuugaacucugugccaaa

SEQ ID NO: 2591 - skipped

SEQ ID NO: 2592 - RNA, 23 nt, Artificial Sequence
  CEP290-1783 targeting domain (RNA)
auguagauugagguagaaucaag

SEQ ID NO: 2593 - RNA, 19 nt, Artificial Sequence
  CEP290-1784 targeting domain (RNA)
agauugagguagaaucaag

SEQ ID NO: 2594 - RNA, 23 nt, Artificial Sequence
  CEP290-1785 targeting domain (RNA)
auaagaugcagaacuaguguaga

SEQ ID NO: 2595 - RNA, 21 nt, Artificial Sequence
  CEP290-1786 targeting domain (RNA)
aagaugcagaacuaguguaga

SEQ ID NO: 2596 - skipped

SEQ ID NO: 2597 - RNA, 18 nt, Artificial Sequence
  CEP290-1788 targeting domain (RNA)
augcagaacuaguguaga

SEQ ID NO: 2598 - RNA, 24 nt, Artificial Sequence
  Targeting domain
auagauguagauugagguagaauc

SEQ ID NO: 2599 - RNA, 22 nt, Artificial Sequence
  Targeting domain
agauguagauugagguagaauc

SEQ ID NO: 2600 - RNA, 20 nt, Artificial Sequence
  Targeting domain
auguagauugagguagaauc

SEQ ID NO: 2601 - RNA, 24 nt, Artificial Sequence
  Targeting domain
agaaugaucauucuuguggcagua

SEQ ID NO: 2602 - RNA, 22 nt, Artificial Sequence
  Targeting domain
aaugaucauucuuguggcagua

SEQ ID NO: 2603 - RNA, 21 nt, Artificial Sequence
  Targeting domain
augaucauucuuguggcagua

SEQ ID NO: 2604 - RNA, 18 nt, Artificial Sequence
  Targeting domain
aucauucuuguggcagua

SEQ ID NO: 2605 - RNA, 23 nt, Artificial Sequence
  Targeting domain
agaaugaucauucuuguggcagu

SEQ ID NO: 2606 - RNA, 21 nt, Artificial Sequence
  Targeting domain
aaugaucauucuuguggcagu

SEQ ID NO: 2607 - skipped

SEQ ID NO: 2608 - RNA, 21 nt, Artificial Sequence
  Targeting domain
agagguaaagguucaugagac

SEQ ID NO: 2609 - RNA, 19 nt, Artificial Sequence
  Targeting domain
agguaaagguucaugagac

SEQ ID NO: 2610 - skipped

SEQ ID NO: 2611 - RNA, 22 nt, Artificial Sequence
  Targeting domain
agcuuuugacaguuuuuaaggc

SEQ ID NO: 2612 - RNA, 23 nt, Artificial Sequence
  Targeting domain
agaaauucacugagcaaaacaac

SEQ ID NO: 2613 - RNA, 21 nt, Artificial Sequence
  Targeting domain
aaauucacugagcaaaacaac

SEQ ID NO: 2614 - skipped

SEQ ID NO: 2615 - RNA, 19 nt, Artificial Sequence
  Targeting domain
auucacugagcaaaacaac

SEQ ID NO: 2616 - RNA, 18 nt, Artificial Sequence
  Targeting domain
aguaaggaggauguaaga

SEQ ID NO: 2617 - RNA, 23 nt, Artificial Sequence
  Targeting domain
aucaaaagacuuauauuccauua

SEQ ID NO: 2618 - skipped

SEQ ID NO: 2619 - RNA, 19 nt, Artificial Sequence
  Targeting domain
aaagacuuauauuccauua

SEQ ID NO: 2620 - RNA, 18 nt, Artificial Sequence
  Targeting domain
aagacuuauauuccauua

SEQ ID NO: 2621 - RNA, 21 nt, Artificial Sequence
  Targeting domain
aggaaauuauuguugcuuuuu

SEQ ID NO: 2622 - RNA, 18 nt, Artificial Sequence
  Targeting domain
aaauuauuguugcuuuuu

SEQ ID NO: 2623 - RNA, 24 nt, Artificial Sequence
  Targeting domain
aaagaaaaacuugaaauuugauag

SEQ ID NO: 2624 - RNA, 23 nt, Artificial Sequence
  Targeting domain
aagaaaaacuugaaauuugauag

SEQ ID NO: 2625 - RNA, 22 nt, Artificial Sequence
  Targeting domain
agaaaaacuugaaauuugauag

SEQ ID NO: 2626 - RNA, 20 nt, Artificial Sequence
  Targeting domain
aaaaacuugaaauuugauag

SEQ ID NO: 2627 - RNA, 19 nt, Artificial Sequence
  Targeting domain
aaaacuugaaauuugauag

SEQ ID NO: 2628 - RNA, 18 nt, Artificial Sequence
  Targeting domain
aaacuugaaauuugauag

SEQ ID NO: 2629 - RNA, 23 nt, Artificial Sequence
  Targeting domain
aagaaaaaagaaauagauguaga

SEQ ID NO: 2630 - RNA, 22 nt, Artificial Sequence
  Targeting domain
agaaaaaagaaauagauguaga

SEQ ID NO: 2631 - RNA, 20 nt, Artificial Sequence
  Targeting domain
aaaaaagaaauagauguaga

SEQ ID NO: 2632 - RNA, 19 nt, Artificial Sequence
  Targeting domain
aaaaagaaauagauguaga

SEQ ID NO: 2633 - RNA, 18 nt, Artificial Sequence
  Targeting domain
aaaagaaauagauguaga

SEQ ID NO: 2634 - RNA, 23 nt, Artificial Sequence
  Targeting domain
agagucucacuguguugcccagg

SEQ ID NO: 2635 - RNA, 21 nt, Artificial Sequence
  Targeting domain
agucucacuguguugcccagg

SEQ ID NO: 2636 - RNA, 24 nt, Artificial Sequence
  Targeting domain
caguuuuuaaggcggggagucaca

SEQ ID NO: 2637 - RNA, 21 nt, Artificial Sequence
  Targeting domain
cugucaaaagcuaccgguuac

SEQ ID NO: 2638 - skipped

SEQ ID NO: 2639 - RNA, 21 nt, Artificial Sequence
  Targeting domain
cacgaaaaucagauuucaugu

SEQ ID NO: 2640 - RNA, 19 nt, Artificial Sequence
  Targeting domain
cgaaaaucagauuucaugu

SEQ ID NO: 2641 - RNA, 23 nt, Artificial Sequence
  Targeting domain
cuaauacaugagagugauuagug

SEQ ID NO: 2642 - RNA, 18 nt, Artificial Sequence
  Targeting domain
cuugaacucugugccaaa

SEQ ID NO: 2643 - RNA, 21 nt, Artificial Sequence
  Targeting domain
cucuagaugacaugagguaag

SEQ ID NO: 2644 - RNA, 19 nt, Artificial Sequence
  Targeting domain
cuagaugacaugagguaag

SEQ ID NO: 2645 - RNA, 24 nt, Artificial Sequence
  Targeting domain
cgguagcuuuugacaguuuuuaag

SEQ ID NO: 2646 - RNA, 18 nt, Artificial Sequence
  Targeting domain
cuuuugacaguuuuuaag

SEQ ID NO: 2647 - skipped

SEQ ID NO: 2648 - RNA, 19 nt, Artificial Sequence
  Targeting domain
caguaaggaggauguaaga

SEQ ID NO: 2649 - RNA, 21 nt, Artificial Sequence
  Targeting domain
caaaagacuuauauuccauua

SEQ ID NO: 2650 - RNA, 24 nt, Artificial Sequence
  Targeting domain
cuuaggaaauuauuguugcuuuuu

SEQ ID NO: 2651 - RNA, 24 nt, Artificial Sequence
  Targeting domain
cuguguugcccaggcuggagugca

SEQ ID NO: 2652 - RNA, 24 nt, Artificial Sequence
  Targeting domain
cagagucucacuguguugcccagg

SEQ ID NO: 2653 - RNA, 18 nt, Artificial Sequence
  Targeting domain
cucacuguguugcccagg

SEQ ID NO: 2654 - RNA, 22 nt, Artificial Sequence
  Targeting domain
guuuuuaaggcggggagucaca

SEQ ID NO: 2655 - RNA, 19 nt, Artificial Sequence
  CEP290-1846 targeting domain (RNA)
gucaaaagcuaccgguuac

SEQ ID NO: 2656 - RNA, 23 nt, Artificial Sequence
  Targeting domain
guucaucucuugcucuagaugac

SEQ ID NO: 2657 - RNA, 24 nt, Artificial Sequence
  Targeting domain
ggucacgaaaaucagauuucaugu

SEQ ID NO: 2658 - RNA, 23 nt, Artificial Sequence
  Targeting domain
gucacgaaaaucagauuucaugu

SEQ ID NO: 2659 - RNA, 18 nt, Artificial Sequence
  Targeting domain
gaaaaucagauuucaugu

SEQ ID NO: 2660 - RNA, 24 nt, Artificial Sequence
  Targeting domain
gcuaauacaugagagugauuagug

SEQ ID NO: 2661 - RNA, 19 nt, Artificial Sequence
  Targeting domain
gcuugaacucugugccaaa

SEQ ID NO: 2662 - RNA, 22 nt, Artificial Sequence
  Targeting domain
gcucuagaugacaugagguaag

SEQ ID NO: 2663 - RNA, 24 nt, Artificial Sequence
  Targeting domain
gauguagauugagguagaaucaag

SEQ ID NO: 2664 - RNA, 21 nt, Artificial Sequence
  Targeting domain
guagauugagguagaaucaag

SEQ ID NO: 2665 - RNA, 18 nt, Artificial Sequence
  Targeting domain
gauugagguagaaucaag

SEQ ID NO: 2666 - RNA, 19 nt, Artificial Sequence
  Targeting domain
gaugcagaacuaguguaga

SEQ ID NO: 2667 - RNA, 21 nt, Artificial Sequence
  Targeting domain
gauguagauugagguagaauc

SEQ ID NO: 2668 - RNA, 18 nt, Artificial Sequence
  Targeting domain
guagauugagguagaauc

SEQ ID NO: 2669 - RNA, 23 nt, Artificial Sequence
  Targeting domain
gaaugaucauucuuguggcagua

SEQ ID NO: 2670 - RNA, 19 nt, Artificial Sequence
  Targeting domain
gaucauucuuguggcagua

SEQ ID NO: 2671 - RNA, 22 nt, Artificial Sequence
  Targeting domain
gaaugaucauucuuguggcagu

SEQ ID NO: 2672 - RNA, 18 nt, Artificial Sequence
  Targeting domain
gaucauucuuguggcagu

SEQ ID NO: 2673 - RNA, 22 nt, Artificial Sequence
  Targeting domain
gagagguaaagguucaugagac

SEQ ID NO: 2674 - RNA, 20 nt, Artificial Sequence
  Targeting domain
gagguaaagguucaugagac

SEQ ID NO: 2675 - RNA, 18 nt, Artificial Sequence
  Targeting domain
gguaaagguucaugagac

SEQ ID NO: 2676 - RNA, 23 nt, Artificial Sequence
  Targeting domain
gguagcuuuugacaguuuuuaag

SEQ ID NO: 2677 - RNA, 22 nt, Artificial Sequence
  Targeting domain
guagcuuuugacaguuuuuaag

SEQ ID NO: 2678 - RNA, 19 nt, Artificial Sequence
  Targeting domain
gcuuuugacaguuuuuaag

SEQ ID NO: 2679 - RNA, 24 nt, Artificial Sequence
  Targeting domain
guagcuuuugacaguuuuuaaggc

SEQ ID NO: 2680 - RNA, 21 nt, Artificial Sequence
  Targeting domain
gcuuuugacaguuuuuaaggc

SEQ ID NO: 2681 - RNA, 22 nt, Artificial Sequence
  Targeting domain
gaaauucacugagcaaaacaac

SEQ ID NO: 2682 - RNA, 23 nt, Artificial Sequence
  Targeting domain
guggcaguaaggaggauguaaga

SEQ ID NO: 2683 - RNA, 21 nt, Artificial Sequence
  Targeting domain
ggcaguaaggaggauguaaga

SEQ ID NO: 2684 - skipped

SEQ ID NO: 2685 - RNA, 20 nt, Artificial Sequence
  Targeting domain
ggaaauuauuguugcuuuuu

SEQ ID NO: 2686 - RNA, 19 nt, Artificial Sequence
  Targeting domain
gaaauuauuguugcuuuuu

SEQ ID NO: 2687 - RNA, 21 nt, Artificial Sequence
  Targeting domain
gaaaaacuugaaauuugauag

SEQ ID NO: 2688 - RNA, 24 nt, Artificial Sequence
  Targeting domain
gaagaaaaaagaaauagauguaga

SEQ ID NO: 2689 - RNA, 21 nt, Artificial Sequence
  Targeting domain
gaaaaaagaaauagauguaga

SEQ ID NO: 2690 - RNA, 22 nt, Artificial Sequence
  Targeting domain
guguugcccaggcuggagugca

SEQ ID NO: 2691 - RNA, 20 nt, Artificial Sequence
  Targeting domain
guugcccaggcuggagugca

SEQ ID NO: 2692 - RNA, 22 nt, Artificial Sequence
  Targeting domain
gagucucacuguguugcccagg

SEQ ID NO: 2693 - RNA, 20 nt, Artificial Sequence
  Targeting domain
gucucacuguguugcccagg

SEQ ID NO: 2694 - RNA, 21 nt, Artificial Sequence
  Targeting domain
uuuuuaaggcggggagucaca

SEQ ID NO: 2695 - skipped

SEQ ID NO: 2696 - RNA, 19 nt, Artificial Sequence
  Targeting domain
uuuaaggcggggagucaca

SEQ ID NO: 2697 - RNA, 18 nt, Artificial Sequence
  Targeting domain
uuaaggcggggagucaca

SEQ ID NO: 2698 - skipped

SEQ ID NO: 2699 - RNA, 18 nt, Artificial Sequence
  Targeting domain
ucaaaagcuaccgguuac

SEQ ID NO: 2700 - RNA, 22 nt, Artificial Sequence
  Targeting domain
uucaucucuugcucuagaugac

SEQ ID NO: 2701 - RNA, 21 nt, Artificial Sequence
  Targeting domain
ucaucucuugcucuagaugac

SEQ ID NO: 2702 - RNA, 18 nt, Artificial Sequence
  Targeting domain
ucucuugcucuagaugac

SEQ ID NO: 2703 - RNA, 22 nt, Artificial Sequence
  Targeting domain
ucacgaaaaucagauuucaugu

SEQ ID NO: 2704 - RNA, 22 nt, Artificial Sequence
  Targeting domain
uaauacaugagagugauuagug

SEQ ID NO: 2705 - RNA, 19 nt, Artificial Sequence
  Targeting domain
uacaugagagugauuagug

SEQ ID NO: 2706 - RNA, 24 nt, Artificial Sequence
  Targeting domain
uauuagcuugaacucugugccaaa

SEQ ID NO: 2707 - RNA, 22 nt, Artificial Sequence
  Targeting domain
uuagcuugaacucugugccaaa

SEQ ID NO: 2708 - RNA, 21 nt, Artificial Sequence
  Targeting domain
uagcuugaacucugugccaaa

SEQ ID NO: 2709 - RNA, 24 nt, Artificial Sequence
  Targeting domain
uugcucuagaugacaugagguaag

SEQ ID NO: 2710 - RNA, 23 nt, Artificial Sequence
  Targeting domain
ugcucuagaugacaugagguaag

SEQ ID NO: 2711 - skipped

SEQ ID NO: 2712 - RNA, 18 nt, Artificial Sequence
  Targeting domain
uagaugacaugagguaag

SEQ ID NO: 2713 - RNA, 22 nt, Artificial Sequence
  Targeting domain
uguagauugagguagaaucaag

SEQ ID NO: 2714 - RNA, 20 nt, Artificial Sequence
  Targeting domain
uagauugagguagaaucaag

SEQ ID NO: 2715 - RNA, 24 nt, Artificial Sequence
  Targeting domain
uauaagaugcagaacuaguguaga

SEQ ID NO: 2716 - RNA, 22 nt, Artificial Sequence
  Targeting domain
uaagaugcagaacuaguguaga

SEQ ID NO: 2717 - RNA, 23 nt, Artificial Sequence
  Targeting domain
uagauguagauugagguagaauc

SEQ ID NO: 2718 - RNA, 19 nt, Artificial Sequence
  Targeting domain
uguagauugagguagaauc

SEQ ID NO: 2719 - skipped

SEQ ID NO: 2720 - RNA, 24 nt, Artificial Sequence
  Targeting domain
uagaaugaucauucuuguggcagu

SEQ ID NO: 2721 - RNA, 19 nt, Artificial Sequence
  Targeting domain
ugaucauucuuguggcagu

SEQ ID NO: 2722 - RNA, 24 nt, Artificial Sequence
  Targeting domain
uugagagguaaagguucaugagac

SEQ ID NO: 2723 - RNA, 23 nt, Artificial Sequence
  Targeting domain
ugagagguaaagguucaugagac

SEQ ID NO: 2724 - RNA, 21 nt, Artificial Sequence
  CEP290-1915 targeting domain (RNA)
uagcuuuugacaguuuuuaag

SEQ ID NO: 2725 - RNA, 23 nt, Artificial Sequence
  Targeting domain
uagcuuuugacaguuuuuaaggc

SEQ ID NO: 2726 - RNA, 19 nt, Artificial Sequence
  Targeting domain
uuuugacaguuuuuaaggc

SEQ ID NO: 2727 - RNA, 18 nt, Artificial Sequence
  CEP290-1918 targeting domain (RNA)
uuugacaguuuuuaaggc

SEQ ID NO: 2728 - RNA, 24 nt, Artificial Sequence
  Targeting domain
uagaaauucacugagcaaaacaac

SEQ ID NO: 2729 - RNA, 18 nt, Artificial Sequence
  Targeting domain
uucacugagcaaaacaac

SEQ ID NO: 2730 - RNA, 24 nt, Artificial Sequence
  Targeting domain
uguggcaguaaggaggauguaaga

SEQ ID NO: 2731 - RNA, 22 nt, Artificial Sequence
  Targeting domain
uggcaguaaggaggauguaaga

SEQ ID NO: 2732 - RNA, 24 nt, Artificial Sequence
  Targeting domain
uaucaaaagacuuauauuccauua

SEQ ID NO: 2733 - RNA, 22 nt, Artificial Sequence
  Targeting domain
ucaaaagacuuauauuccauua

SEQ ID NO: 2734 - RNA, 23 nt, Artificial Sequence
  Targeting domain
uuaggaaauuauuguugcuuuuu

SEQ ID NO: 2735 - RNA, 22 nt, Artificial Sequence
  Targeting domain
uaggaaauuauuguugcuuuuu

SEQ ID NO: 2736 - RNA, 23 nt, Artificial Sequence
  CEP290-1927 targeting domain
uguguugcccaggcuggagugca

SEQ ID NO: 2737 - RNA, 21 nt, Artificial Sequence
  Targeting domain
uguugcccaggcuggagugca

SEQ ID NO: 2738 - RNA, 19 nt, Artificial Sequence
  Targeting domain
uugcccaggcuggagugca

SEQ ID NO: 2739 - RNA, 18 nt, Artificial Sequence
  CEP290-1930 targeting domain
ugcccaggcuggagugca

SEQ ID NO: 2740 - RNA, 19 nt, Artificial Sequence
  CEP290-1931 targeting domain
ucucacuguguugcccagg

SEQ ID NO: 2741-2747 - skipped (7 entries)

SEQ ID NO: 2748 - RNA, 20 nt, Artificial Sequence
  CEP290-1940 targeting domain (RNA)
acuuaaugagugcuucccuc

SEQ ID NO: 2749-2751 - skipped (3 entries)

SEQ ID NO: 2752 - RNA, 17 nt, Artificial Sequence
  CEP290-1944 targeting domain (RNA)
agggucugguccauauu

SEQ ID NO: 2753 - RNA, 20 nt, Artificial Sequence
  CEP290-1945 targeting domain (RNA)
auaguggcugaaugacuucu

SEQ ID NO: 2754 - RNA, 17 nt, Artificial Sequence
  CEP290-1946 targeting domain (RNA)
augucugguuaaaagag

SEQ ID NO: 2755 - RNA, 20 nt, Artificial Sequence
  CEP290-1947 targeting domain (RNA)
caaagggucugguccauauu

SEQ ID NO: 2756-2760 - skipped (5 entries)

SEQ ID NO: 2761 - RNA, 17 nt, Artificial Sequence
  CEP290-1953 targeting domain (RNA)
uaaugagugcuucccuc

SEQ ID NO: 2762 - RNA, 20 nt, Artificial Sequence
  CEP290-1954 targeting domain (RNA)
uagaugucugguuaaaagag

SEQ ID NO: 2763 - RNA, 20 nt, Artificial Sequence
  CEP290-1955 targeting domain (RNA)
ucauucuccuuaggucacuu

SEQ ID NO: 2764 - skipped

SEQ ID NO: 2765 - RNA, 17 nt, Artificial Sequence
  CEP290-1957 targeting domain (RNA)
uucuccuuaggucacuu

SEQ ID NO: 2766 - RNA, 17 nt, Artificial Sequence
  CEP290-1958 targeting domain (RNA)
aagaaaaaagaaauaga

SEQ ID NO: 2767 - RNA, 20 nt, Artificial Sequence
  CEP290-1959 targeting domain (RNA)
agauugagguagaaucaaga

SEQ ID NO: 2768 - skipped

SEQ ID NO: 2769 - RNA, 17 nt, Artificial Sequence
  CEP290-1961 targeting domain (RNA)
caaaaaaagaauccucu

SEQ ID NO: 2770 - RNA, 20 nt, Artificial Sequence
  CEP290-1962 targeting domain (RNA)
caacaaaaaaagaauccucu

SEQ ID NO: 2771 - skipped

SEQ ID NO: 2772 - RNA, 17 nt, Artificial Sequence
  CEP290-1964 targeting domain (RNA)
cauucuucacacaugaa

SEQ ID NO: 2773 - RNA, 20 nt, Artificial Sequence
  CEP290-1965 targeting domain (RNA)
uagaagaaaaaagaaauaga

SEQ ID NO: 2774 - RNA, 20 nt, Artificial Sequence
  CEP290-1966 targeting domain (RNA)
ugagacuagaggucacgaaa

SEQ ID NO: 2775 - skipped

SEQ ID NO: 2776 - RNA, 20 nt, Artificial Sequence
  CEP290-1968 targeting domain (RNA)
uuccauucuucacacaugaa

SEQ ID NO: 2777 - RNA, 17 nt, Artificial Sequence
  CEP290-1969 targeting domain (RNA)
uugagguagaaucaaga

SEQ ID NO: 2778 - skipped

SEQ ID NO: 2779 - RNA, 102 nt, Artificial Sequence
  S. aureus gRNA
  misc_feature (1)..(20): Targeting domain, each n is a, c, u, g, unknown, or other
nnnnnnnnnnnnnnnnnnnnguuuuaguacucuggaaacagaaucuacuaaaacaaggcaaaaugccguguuuaucucgucaacuuguuggcgagauuuuuu

SEQ ID NO: 2780 - RNA, 17 nt, Artificial Sequence
  CEP290-B41/-B1291 targeting domain (RNA)
ucauucuuguggcagua

SEQ ID NO: 2781 - DNA, 22 bp, Artificial Sequence
  CEP290-230 targeting domain (DNA)
ggcacagagttcaagctaatac

SEQ ID NO: 2782 - DNA, 22 bp, Artificial Sequence
  CEP290-312/-926 targeting domain (DNA)
gactcataatttagtaggaatc

SEQ ID NO: 2783 - DNA, 20 bp, Artificial Sequence
  CEP290-B1036/-482 targeting domain (DNA)
gaaatagaggcttatggatt

SEQ ID NO: 2784 - DNA, 19 bp, Artificial Sequence
  CEP290-485 targeting domain (DNA)
ggataggacagaggacatg

SEQ ID NO: 2785 - DNA, 102 bp, Artificial Sequence
  S. aureus gRNA
  misc_feature (1)..(20): Targeting domain, each n is a, c, t, g, unknown, or other
nnnnnnnnnnnnnnnnnnnngttttagtactctggaaacagaatctactaaaacaaggcaaaatgccgtgtttatctcgtcaacttgttggcgagatttttt

SEQ ID NO: 2786 - RNA, 102 nt, Artificial Sequence
  S. aureus gRNA
  misc_feature (1)..(20): Targeting domain, each n is a, c, u, g, unknown, or other
nnnnnnnnnnnnnnnnnnnnguuauaguacucuggaaacagaaucuacuauaacaaggcaaaaugccguguuuaucucgucaacuuguuggcgagauuuuuu

SEQ ID NO: 2787 - DNA, 102 bp, Artificial Sequence
  S. aureus gRNA
  misc_feature (1)..(20): Targeting domain, each n is a, c, t, g, unknown, or other
nnnnnnnnnnnnnnnnnnnngttatagtactctggaaacagaatctactataacaaggcaaaatgccgtgtttatctcgtcaacttgttggcgagatttttt

SEQ ID NO: 2788 - DNA, 36 bp, Mus musculus
ccctcaaacacatgtctcacgcagcttagacattct

SEQ ID NO: 2789 - DNA, 35 bp, Mus musculus
cagaactcggtcagcatgctacagatagcttatct

SEQ ID NO: 2790 - DNA, 36 bp, Mus musculus
cagaactcggtcaggcatgctacagatagcttatct

SEQ ID NO: 2791 - DNA, 31 bp, Mus musculus
cagaactcggcatgctacagatagcttatct

SEQ ID NO: 2792 - DNA, 9 bp, Mus musculus
ccctcaaag

SEQ ID NO: 2793 - DNA, 21 bp, Mus musculus
catgctacagatagcttatct

SEQ ID NO: 2794 - DNA, 21 bp, Artificial Sequence
  C1 targeting domain (DNA)
ggccggctaatttagtagaga

SEQ ID NO: 2795 - RNA, 21 nt, Artificial Sequence
  C1 targeting domain (RNA)
ggccggcuaauuuaguagaga

SEQ ID NO: 2796 - DNA, 20 bp, Artificial Sequence
  C2 targeting domain (DNA)
gttatgaagaataatacaaa

SEQ ID NO: 2797 - RNA, 20 nt, Artificial Sequence
  C2 targeting domain (RNA)
guuaugaagaauaauacaaa

SEQ ID NO: 2798 - DNA, 5120 bp, Artificial Sequence
  pAD26/SplitGFP+WildType/CEP290/Kan
acataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgctaatacgactcactatagggagagccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggaggtaagtttgtgtgattcttgaaccttgtgaaattagccatttttcttcaatatttttgtgtttggggggatttggcagattttaattaaagtttgcctgcatttatataaatttaacagagatataattatccatattattcattgtggctgaatgacttctgaatgattatctagatcattctccttaggtcacttgcatgatttagctgaatcaaacctcttttaaccagacatctaagagaaaaaggagcatgaaacaggtagaatattgtaatcaaaggagggaagcactcattaagtgcccatccctttctcttacccctgtacccagaacaaactattctcccatggtccctggcttttgttccttggaatggatgtagccaacagtagctgaaatattaagggctcttcctggaccatggatgcactctgtaaattctcatcattttttattgtagaataaatgtagaattttaatgtagaataaatttatttaatgtagaataaaaaataaaaaaactagagtagaatatcataagttacaatctgtgaatatggaccagaccctttgtagttatcttacagccacttgaactctataccttttactgaggacagaacaagctcctgatttgttcatcttcctcatcagaaatagaggcttatggattttggattattcttatctaagatcctttcacaggagtagaataagatctaattctattagctcaaaagcttttgctggctcatagagacacattcagtaaatgaaaacgttgttctgagtagctttcaggattcctactaaattatgagtcatgtttatcaatattatttagaagtaatcataatcagtttgctttctgctgcttttgccaaagagaggtgattatgttactttttatagaaaattatgcctatttagtgtggtgataatttatttttttccattctccatgtcctctgtcctatcctctccagcattagaaagtcctaggcaagagacatcttgtggataatgtatcaatgagtgatgtttaacgttatcattttcccaaagagtatttttcatctttcctaaagattttttttttttttttttgagatggagtttcattctgtcacccaggctgagtgcagtggcacgatctcggcttaacgcttactgcatcctctgcctcccagattcaagcagttctcctgcctcagcctctgagtagctgggattacaggtgtgcaccaccacaccagctaatttttttttttttttttttttttttgaggcagagtctcgctctgtcacccaggctggagtgcagtggcgccatcttggctcactgcaagctccacctcccgggttcaggccgttctcctgcctcagcctcctgagtagctggtaccacaggcacccaccatcatgcccggctaattttttgtatttttagtagagatggggtttcaccttgttagccaggatggtgtcgatctcctgaactcgtgatccacccgcctcggcctcctaaagtgctgggattacagatgtgagccaccgcacctggccccagttgtaattgtgaatatctcatacctatccctattggcagtgtcttagttttattttttattatctttattgtggcagccattattcctgtctctatctccagtcttacatcctccttactgccacaagaatgatcattctaaacatgaatcctaccctgtgactcccatgtgactccccgccttaaaaactgtcaaaagctaccggttacctgaagggtaaaagtcaagtcccctacttacctcatgtcatctagagcaagagatgaactagctgagttttctgaccacagtgttctttcttatgtatgttcttttgtacgtgctcttttctatatatagggaaccatttctctcttccagttgttttgctcagtgaatttctattcctgtttcaaaacttgttcaggcattaccttttttttcttaagcatactttttttaatggaacaaagtcactcctgtctacactagttctgcatcttatacataggttttgtacatagtacatatttatatcacatcaaattatatgtgtttacatatctgtcttccttaatggaatataagtcttttgatataaggaactatttaatttgtttctgtgtgttgagtatctcctgtttggcacagagttcaagctaatacatgagagtgattagtggtggagagccacagtgcatgtggtgtcaaatatggtgcttaggaaattattgttgctttttgagaggtaaaggttcatgagactagaggtcacgaaaatcagatttcatgtgtgaagaatggaatagatgtattatatatggaggaaattctaattttgtaaaaaactggattgtgagttttaaggagatgttatataaagttaagacaatgtcattttgtggtattggtctgaattacaatgtagtttcttagtgatatttttcctttattcagtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtcgagctagcaataaaggatcgtttattttcattggaagcgtgtgttggttttttgatcaggcgcgtccaagcttgcatgctggggagagatctgcggccgctcgagtggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtgtcgtgaccgcgggcggccgccgctagcgctaccggtcgccaccatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtgaccggtcatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaa

SEQ ID NO: 2799 - DNA, 5120 bp, Artificial Sequence
  pAD27/SplitGFP+Mutant/CEP290/Kan
acataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgctaatacgactcactatagggagagccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggaggtaagtttgtgtgattcttgaaccttgtgaaattagccatttttcttcaatatttttgtgtttggggggatttggcagattttaattaaagtttgcctgcatttatataaatttaacagagatataattatccatattattcattgtggctgaatgacttctgaatgattatctagatcattctccttaggtcacttgcatgatttagctgaatcaaacctcttttaaccagacatctaagagaaaaaggagcatgaaacaggtagaatattgtaatcaaaggagggaagcactcattaagtgcccatccctttctcttacccctgtacccagaacaaactattctcccatggtccctggcttttgttccttggaatggatgtagccaacagtagctgaaatattaagggctcttcctggaccatggatgcactctgtaaattctcatcattttttattgtagaataaatgtagaattttaatgtagaataaatttatttaatgtagaataaaaaataaaaaaactagagtagaatatcataagttacaatctgtgaatatggaccagaccctttgtagttatcttacagccacttgaactctataccttttactgaggacagaacaagctcctgatttgttcatcttcctcatcagaaatagaggcttatggattttggattattcttatctaagatcctttcacaggagtagaataagatctaattctattagctcaaaagcttttgctggctcatagagacacattcagtaaatgaaaacgttgttctgagtagctttcaggattcctactaaattatgagtcatgtttatcaatattatttagaagtaatcataatcagtttgctttctgctgcttttgccaaagagaggtgattatgttactttttatagaaaattatgcctatttagtgtggtgataatttatttttttccattctccatgtcctctgtcctatcctctccagcattagaaagtcctaggcaagagacatcttgtggataatgtatcaatgagtgatgtttaacgttatcattttcccaaagagtatttttcatctttcctaaagattttttttttttttttttgagatggagtttcattctgtcacccaggctgagtgcagtggcacgatctcggcttaacgcttactgcatcctctgcctcccagattcaagcagttctcctgcctcagcctctgagtagctgggattacaggtgtgcaccaccacaccagctaatttttttttttttttttttttttttgaggcagagtctcgctctgtcacccaggctggagtgcagtggcgccatcttggctcactgcaagctccacctcccgggttcaggccgttctcctgcctcagcctcctgagtagctggtaccacaggcacccaccatcatgcccggctaattttttgtatttttagtagagatggggtttcaccttgttagccaggatggtgtcgatctcctgaactcgtgatccacccgcctcggcctcctaaagtgctgggattacagatgtgagccaccgcacctggccccagttgtaattgtgagtatctcatacctatccctattggcagtgtcttagttttattttttattatctttattgtggcagccattattcctgtctctatctccagtcttacatcctccttactgccacaagaatgatcattctaaacatgaatcctaccctgtgactcccatgtgactccccgccttaaaaactgtcaaaagctaccggttacctgaagggtaaaagtcaagtcccctacttacctcatgtcatctaaagcaagagatgaactagctgagttttctgaccacagtgttctttcttatgtatgttcttttgtacgtgctcttttctatatatagggaaccatttctctcttccagttgttttgctcagtgaatttctattcctgtttcaaaacttgttcaggcattaccttttttttcttaagcatactttttttaatggaacaaagtcactcctgtctacactagttctgcatcttatacataggttttgtacatagtacatatttatatcacatcaaattatatgtgtttacatatctgtcttccttaatggaatataagtcttttgatataaggaactatttaatttgtttctgtgtgttgagtatctcctgtttggcacagagttcaagctaatacatgagagtgattagtggtggagagccacagtgcatgtggtgtcaaatatggtgcttaggaaattattgttgctttttgagaggtaaaggttcatgagactagaggtcacgaaaatcagatttcatgtgtgaagaatggaatagatgtattatatatggaggaaattctaattttgtaaaaaactggattgtgagttttaaggagatgttatataaagttaagacaatgtcattttgtggtattggtctgaattacaatgtagtttcttagtgatatttttcctttattcagtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtcgagctagcaataaaggatcgtttattttcattggaagcgtgtgttggttttttgatcaggcgcgtccaagcttgcatgctggggagagatctgcggccgctcgagtggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtgtcgtgaccgcgggcggccgccgctagcgctaccggtcgccaccatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtgaccggtcatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaa

SEQ ID NO: 2800 - DNA, 5120 bp, Artificial Sequence
  pAD28/SplitGFP+Mutant/CEP290/Inverted/Kan
acataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgctaatacgactcactatagggagagccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggaggtaagtttgtgtgattcttgaaccttgtgaaattagccatttttcttcaatatttttgtgtttggggggatttggcagattttaattaaagtttgcctgcatttatataaatttaacagagatataattatccatattattcattgtggctgaatgacttctgaatgattatctagatcattctccttaggtcacttgcatgatttagctgaatcaaacctcttttaaccagacatctaagagaaaaaggagcatgaaacaggtagaatattgtaatcaaaggagggaagcactcattaagtgcccatccctttctcttacccctgtacccagaacaaactattctcccatggtccctggcttttgttccttggaatggatgtagccaacagtagctgaaatattaagggctcttcctggaccatggatgcactctgtaaattctcatcattttttattgtagaataaatgtagaattttaatgtagaataaatttatttaatgtagaataaaaaataaaaaaactagagtagaatatcataagttacaatctgtgaatatggaccagaccctttgtagttatcttacagccacttgaactctatacgtaaccggtagcttttgacagtttttaaggcggggagtcacatgggagtcacagggtaggattcatgtttagaatgatcattcttgtggcagtaaggaggatgtaagactggagatagagacaggaataatggctgccacaataaagataataaaaaataaaactaagacactgccaatagggataggtatgagatactcacaattacaactggggccaggtgcggtggctcacatctgtaatcccagcactttaggaggccgaggcgggtggatcacgagttcaggagatcgacaccatcctggctaacaaggtgaaaccccatctctactaaaaatacaaaaaattagccgggcatgatggtgggtgcctgtggtaccagctactcaggaggctgaggcaggagaacggcctgaacccgggaggtggagcttgcagtgagccaagatggcgccactgcactccagcctgggtgacagagcgagactctgcctcaaaaaaaaaaaaaaaaaaaaaaaaattagctggtgtggtggtgcacacctgtaatcccagctactcagaggctgaggcaggagaactgcttgaatctgggaggcagaggatgcagtaagcgttaagccgagatcgtgccactgcactcagcctgggtgacagaatgaaactccatctcaaaaaaaaaaaaaaaaaatctttaggaaagatgaaaaatactctttgggaaaatgataacgttaaacatcactcattgatacattatccacaagatgtctcttgcctaggactttctaatgctggagaggataggacagaggacatggagaatggaaaaaaataaattatcaccacactaaataggcataattttctataaaaagtaacataatcacctctctttggcaaaagcagcagaaagcaaactgattatgattacttctaaataatattgataaacatgactcataatttagtaggaatcctgaaagctactcagaacaacgttttcatttactgaatgtgtctctatgagccagcaaaagcttttgagctaatagaattagatcttattctactcctgtgaaaggatcttagataagaataatccaaaatccataagcctctatttctgatgaggaagatgaacaaatcaggagcttgttctgtcctcagtaaaagctgaagggtaaaagtcaagtcccctacttacctcatgtcatctaaagcaagagatgaactagctgagttttctgaccacagtgttctttcttatgtatgttcttttgtacgtgctcttttctatatatagggaaccatttctctcttccagttgttttgctcagtgaatttctattcctgtttcaaaacttgttcaggcattaccttttttttcttaagcatactttttttaatggaacaaagtcactcctgtctacactagttctgcatcttatacataggttttgtacatagtacatatttatatcacatcaaattatatgtgtttacatatctgtcttccttaatggaatataagtcttttgatataaggaactatttaatttgtttctgtgtgttgagtatctcctgtttggcacagagttcaagctaatacatgagagtgattagtggtggagagccacagtgcatgtggtgtcaaatatggtgcttaggaaattattgttgctttttgagaggtaaaggttcatgagactagaggtcacgaaaatcagatttcatgtgtgaagaatggaatagatgtattatatatggaggaaattctaattttgtaaaaaactggattgtgagttttaaggagatgttatataaagttaagacaatgtcattttgtggtattggtctgaattacaatgtagtttcttagtgatatttttcctttattcagtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtcgagctagcaataaaggatcgtttattttcattggaagcgtgtgttggttttttgatcaggcgcgtccaagcttgcatgctggggagagatctgcggccgctcgagtggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtgtcgtgaccgcgggcggccgccgctagcgctaccggtcgccaccatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtgaccggtcatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaa

SEQ ID NO: 2801 - DNA, 3944 bp, Artificial Sequence
  pAD29/SplitGFP+Deletion/CEP290/Kan
acataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgctaatacgactcactatagggagagccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggaggtaagtttgtgtgattcttgaaccttgtgaaattagccatttttcttcaatatttttgtgtttggggggatttggcagattttaattaaagtttgcctgcatttatataaatttaacagagatataattatccatattattcattgtggctgaatgacttctgaatgattatctagatcattctccttaggtcacttgcatgatttagctgaatcaaacctcttttaaccagacatctaagagaaaaaggagcatgaaacaggtagaatattgtaatcaaaggagggaagcactcattaagtgcccatccctttctcttacccctgtacccagaacaaactattctcccatggtccctggcttttgttccttggaatggatgtagccaacagtagctgaaatattaagggctcttcctggaccatggatgcactctgtaaattctcatcattttttattgtagaataaatgtagaattttaatgtagaataaatttatttaatgtagaataaaaaataaaaaaactagagtagaatatcataagttacaatctgtgaatatggaccagaccctttgtagttatcttacagccacttgaactctatacctgaagggtaaaagtcaagtcccctacttacctcatgtcatctaaagcaagagatgaactagctgagttttctgaccacagtgttctttcttatgtatgttcttttgtacgtgctcttttctatatatagggaaccatttctctcttccagttgttttgctcagtgaatttctattcctgtttcaaaacttgttcaggcattaccttttttttcttaagcatactttttttaatggaacaaagtcactcctgtctacactagttctgcatcttatacataggttttgtacatagtacatatttatatcacatcaaattatatgtgtttacatatctgtcttccttaatggaatataagtcttttgatataaggaactatttaatttgtttctgtgtgttgagtatctcctgtttggcacagagttcaagctaatacatgagagtgattagtggtggagagccacagtgcatgtggtgtcaaatatggtgcttaggaaattattgttgctttttgagaggtaaaggttcatgagactagaggtcacgaaaatcagatttcatgtgtgaagaatggaatagatgtattatatatggaggaaattctaattttgtaaaaaactggattgtgagttttaaggagatgttatataaagttaagacaatgtcattttgtggtattggtctgaattacaatgtagtttcttagtgatatttttcctttattcagtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtcgagctagcaataaaggatcgtttattttcattggaagcgtgtgttggttttttgatcaggcgcgtccaagcttgcatgctggggagagatctgcggccgctcgagtggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtgtcgtgaccgcgggcggccgccgctagcgctaccggtcgccaccatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtgaccggtcatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaa

What is claimed is:

1. A method of treating LCA10 in a subject in need thereof comprising administering to an eye of the subject:
an adeno-associated virus 5 (AAV5) vector capable of delivery to a non-dividing cell comprising in the same vector:
(i) a nucleotide sequence encoding a first gRNA molecule comprising a first targeting domain complementary with a first target domain from a CEP290 gene;
(ii) a nucleotide sequence encoding a second gRNA molecule comprising a second targeting domain complementary with a second target domain from the CEP290 gene; and
(iii) a nucleotide sequence encoding a Cas9 molecule;
wherein the AAV5 vector is administered to the subject at a dose selected from the group of AAV5 vector concentrations consisting of $6 \times 10^{11}$ viral genomes (vg)/mL, $1 \times 10^{12}$ vg/mL, and $3 \times 10^{12}$ vg/mL and
wherein the administration results in NHEJ-mediated alteration of a LCA10 target position in the CEP290 gene in one or more cells of the subject, thereby treating the subject.

2. The method of claim 1, wherein the first gRNA molecule is configured to form a first complex with the Cas9 molecule, and the second gRNA molecule is configured to form a second complex with the Cas9 molecule, and the first complex is configured to form a first DNA double strand break between the 5' end of the Alu repeat at c.2991+1162 to c.2991.1638 of intron 26 of the CEP290 gene and 500 nucleotides upstream of the 5' end of the Alu repeat, and the second complex is configured to form a second DNA double strand break between the LCA10 target position and 500 nucleotides downstream of the LCA10 target position.

3. The method of claim 1, wherein the first targeting domain comprises a nucleotide sequence selected from the group consisting of SEQ ID NO:530 (CEP290-323), SEQ ID NO:555 (CEP290-485), SEQ ID NO:468 (CEP290-490), and SEQ ID NO:538 (CEP290-492) and the second targeting domain comprises a nucleotide sequence selected from the group consisting of SEQ ID NO:558 (CEP290-64), SEQ ID NO:2321 (CEP290-11), SEQ ID NO:2312 (CEP290-230), SEQ ID NO:460 (CEP290-496), SEQ ID NO:586 (CEP290-502), and SEQ ID NO:568 (CEP290-504).

4. The method of claim 3, wherein the AAV5 vector is administered to a retina of the eye of the subject.

5. The method of claim 3, wherein the Cas9 molecule is an S. aureus Cas9 molecule.

6. The method of claim 5, wherein the S. aureus Cas9 molecule comprises an amino acid sequence having at least 90% sequence identity to SEQ ID NO: 26.

7. The method of claim 6, wherein in the first gRNA comprises a sequence having at least 90% sequence identity to a sequence selected from SEQ ID NOs: 2785 and 2787.

8. The method of claim 7, wherein the AAV5 vector encodes left and right ITRs having at least 90% sequence identity to SEQ ID NOs: 408 and 437.

9. The method of claim 8, wherein the AAV5 vector comprises a U6 promoter sequence having at least 90% sequence identity to SEQ ID NO: 417 and being operably coupled to a sequence encoding the first gRNA.

10. The method of claim 9, wherein the AAV5 vector comprises a promoter sequence selected from the group consisting of:
a CMV promoter sequence having at least 90% sequence identity to SEQ ID NO: 401,
an EFS promoter sequence having at least 90% sequence identity to SEQ ID NO: 402, or
an hGRK promoter sequence having at least 90% sequence identity to SEQ ID NO: 403.

11. The method of claim 10, wherein the first targeting domain comprises a nucleotide sequence consisting of SEQ ID NO:530 (CEP290-323) and the second targeting domain comprises a nucleotide sequence selected from the group consisting of SEQ ID NO:558 (CEP290-64) and SEQ ID NO:2321 (CEP290-11).

12. The method of claim 10, wherein the first targeting domain comprises a nucleotide sequence consisting of SEQ ID NO:468 (CEP290-490) and the second targeting domain comprises a nucleotide sequence selected from the group consisting of SEQ ID NO:460 (CEP290-496), SEQ ID NO:586 (CEP290-502), and SEQ ID NO:568 (CEP290-504).

13. The method of claim 10, wherein the first targeting domain comprises a nucleotide sequence consisting of SEQ ID NO:538 (CEP290-492) and the second targeting domain comprises a nucleotide sequence selected from the group consisting of SEQ ID NO:586 (CEP290-502) and SEQ ID NO:568 (CEP290-504).

14. The method of claim 10, wherein the first targeting domain comprises a nucleotide sequence selected from the group consisting of SEQ ID NO:530 (CEP290-323), SEQ ID NO:555 (CEP290-485), SEQ ID NO:468 (CEP290-490), and SEQ ID NO:538 (CEP290-492) and the second targeting domain comprises the nucleotide sequence consisting of SEQ ID NO:558 (CEP290-64).

15. The method of claim 10, wherein the first targeting domain comprises a nucleotide sequence selected from the group consisting of SEQ ID NO:530 (CEP290-323), SEQ ID NO:555 (CEP290-485), SEQ ID NO:468 (CEP290-490), and SEQ ID NO:538 (CEP290-492) and the second targeting domain comprises the nucleotide sequence consisting of SEQ ID NO:558 (CEP290-64).

16. The method of claim 10, wherein the first targeting domain comprises the nucleotide sequence consisting of SEQ ID NO:530 (CEP290-323) and the second targeting domain comprises the nucleotide sequence consisting of SEQ ID NO:558 (CEP290-64).

17. The method of claim 16, wherein the dose is $6\times10^{11}$ vg/mL.

18. The method of claim 16, wherein the dose is $1\times10^{12}$ vg/mL.

19. The method of claim 16, wherein the dose is $3\times10^{12}$ vg/mL.

20. A method of treating LCA10 in a subject in need thereof comprising administering to an eye of the subject an adeno-associated virus 5 (AAV5) recombinant viral particle capable of delivery to a non-dividing cell comprising:
   (i) a nucleotide sequence encoding a first gRNA molecule comprising a first targeting domain complementary with a first target domain from a CEP290 gene;
   (ii) a nucleotide sequence encoding a second gRNA molecule comprising a second targeting domain complementary with a second target domain from the CEP290 gene; and
   (iii) a nucleotide sequence encoding a Cas9 molecule;
   wherein the AAV5 recombinant viral particle is administered to the subject at a dose selected from the group of AAV5 recombinant viral particle concentrations consisting of $6\times10^{11}$ viral genomes (vg)/mL, $1\times10^{12}$ vg/mL, and $3\times10^{12}$ vg/mL and
   wherein the administration results in NHEJ-mediated alteration of a LCA10 target position in the CEP290 gene in one or more cells of the subject, thereby treating the subject.

21. The method of claim 20, wherein the first gRNA molecule is configured to form a first complex with the Cas9 molecule, and the second gRNA molecule is configured to form a second complex with the Cas9 molecule, and the first complex is configured to form a first DNA double strand break between the 5' end of the Alu repeat at c.2991+1162 to c.2991.1638 of intron 26 of the CEP290 gene and 500 nucleotides upstream of the 5' end of the Alu repeat, and the second complex is configured to form a second DNA double strand break between the LCA10 target position and 500 nucleotides downstream of the LCA10 target position.

22. The method of claim 20, wherein the first targeting domain comprises a nucleotide sequence selected from the group consisting of SEQ ID NO:530 (CEP290-323), SEQ ID NO:555 (CEP290-485), SEQ ID NO:468 (CEP290-490), and SEQ ID NO:538 (CEP290-492) and the second targeting domain comprises a nucleotide sequence selected from the group consisting of SEQ ID NO:558 (CEP290-64), SEQ ID NO:2321 (CEP290-11), SEQ ID NO:2312 (CEP290-230), SEQ ID NO:460 (CEP290-496), SEQ ID NO:586 (CEP290-502), and SEQ ID NO:568 (CEP290-504).

23. The method of claim 22, wherein the AAV5 recombinant viral particle is administered to a retina of the eye of the subject.

24. The method of claim 22, wherein the Cas9 molecule is an *S. aureus* Cas9 molecule.

25. The method of claim 24, wherein the *S. aureus* Cas9 molecule comprises an amino acid sequence having at least 90% sequence identity to SEQ ID NO: 26.

26. The method of claim 25, wherein in the first gRNA comprises a sequence having at least 90% sequence identity to a sequence selected from SEQ ID NOs: 2785 and 2787.

27. The method of claim 26, wherein the AAV5 recombinant viral particle encodes left and right ITRs having at least 90% sequence identity to SEQ ID NOs: 408 and 437.

28. The method of claim 27, wherein the AAV5 recombinant viral particle comprises a U6 promoter sequence having at least 90% sequence identity to SEQ ID NO: 417 and being operably coupled to a sequence encoding the first gRNA.

29. The method of claim 28, wherein the AAV5 recombinant viral particle comprises a promoter sequence selected from the group consisting of:
   a CMV promoter sequence having at least 90% sequence identity to SEQ ID NO: 401,
   an EFS promoter sequence having at least 90% sequence identity to SEQ ID NO: 402, or
   an hGRK promoter sequence having at least 90% sequence identity to SEQ ID NO: 403.

30. The method of claim 29, wherein the first targeting domain comprises a nucleotide sequence consisting of SEQ ID NO:530 (CEP290-323) and the second targeting domain comprises a nucleotide sequence selected from the group consisting of SEQ ID NO:558 (CEP290-64) and SEQ ID NO:2321 (CEP290-11).

31. The method of claim 29, wherein the first targeting domain comprises a nucleotide sequence consisting of SEQ ID NO:468 (CEP290-490) and the second targeting domain comprises a nucleotide sequence selected from the group consisting of SEQ ID NO:460 (CEP290-496), SEQ ID NO:586 (CEP290-502), and SEQ ID NO:568 (CEP290-504).

32. The method of claim 29, wherein the first targeting domain comprises a nucleotide sequence consisting of SEQ ID NO:538 (CEP290-492) and the second targeting domain comprises a nucleotide sequence selected from the group consisting of SEQ ID NO:586 (CEP290-502) and SEQ ID NO:568 (CEP290-504).

33. The method of claim 29, wherein the first targeting domain comprises a nucleotide sequence selected from the group consisting of SEQ ID NO:530 (CEP290-323), SEQ ID NO:555 (CEP290-485), SEQ ID NO:468 (CEP290-490), and SEQ ID NO:538 (CEP290-492) and the second targeting domain comprises the nucleotide sequence consisting of SEQ ID NO:558 (CEP290-64).

34. The method of claim 29, wherein the first targeting domain comprises a nucleotide sequence selected from the group consisting of SEQ ID NO:530 (CEP290-323), SEQ ID NO:555 (CEP290-485), SEQ ID NO:468 (CEP290-490), and SEQ ID NO:538 (CEP290-492) and the second targeting domain comprises the nucleotide sequence consisting of SEQ ID NO:558 (CEP290-64).

35. The method of claim 29, wherein the first targeting domain comprises the nucleotide sequence consisting of SEQ ID NO:530 (CEP290-323) and the second targeting domain comprises the nucleotide sequence consisting of SEQ ID NO:558 (CEP290-64).

36. The method of claim 35, wherein the dose is $6\times10^{11}$ vg/mL.

37. The method of claim 35, wherein the dose is $1\times10^{12}$ vg/mL.

38. The method of claim 35, wherein the dose is $3\times10^{12}$ vg/mL.

39. A method of treating LCA10 in a subject in need thereof comprising administering to the eye of the subject:
   an adeno-associated virus 5 (AAV5) vector capable of delivery to a non-dividing cell comprising:
      (i) a nucleotide sequence encoding a first gRNA molecule comprising a first targeting domain complementary with a first target domain from a CEP290 gene; and (ii) a nucleotide sequence encoding a second gRNA molecule comprising a second targeting domain complementary with a second target domain from the CEP290 gene; and a Cas9 molecule;

wherein the AAV5 vector is administered to the subject at a dose selected from the group of AAV5 vector concentrations consisting of $6\times10^{11}$ viral genomes (vg)/mL, $1\times10^{12}$ vg/mL, and $3\times10^{12}$ vg/mL and wherein the administration results in NHEJ-mediated alteration of a LCA10 target position in the CEP290 gene in one or more cells of the subject, thereby treating the subject.

40. The method of claim 39, wherein the first gRNA molecule is configured to form a first complex with the Cas9 molecule, and the second gRNA molecule is configured to form a second complex with the Cas9 molecule, and the first complex is configured to form a first DNA double strand break between the 5' end of the Alu repeat at c.2991+1162 to c.2991.1638 of intron 26 of the CEP290 gene and 500 nucleotides upstream of the 5' end of the Alu repeat, and the second complex is configured to form a second DNA double strand break between the LCA10 target position and 500 nucleotides downstream of the LCA10 target position.

41. The method of claim 39, wherein the first targeting domain comprises a nucleotide sequence selected from the group consisting of SEQ ID NO:530 (CEP290-323), SEQ ID NO:555 (CEP290-485), SEQ ID NO:468 (CEP290-490), and SEQ ID NO:538 (CEP290-492) and the second targeting domain comprises a nucleotide sequence selected from the group consisting of SEQ ID NO:558 (CEP290-64), SEQ ID NO:2321 (CEP290-11), SEQ ID NO:2312 (CEP290-230), SEQ ID NO:460 (CEP290-496), SEQ ID NO:586 (CEP290-502), and SEQ ID NO:568 (CEP290-504).

42. The method of claim 39, wherein the AAV5 vector is administered to a retina of the eye of the subject.

43. The method of claim 41, wherein the Cas9 molecule is an *S. aureus* Cas9 molecule.

44. The method of claim 43, wherein the *S. aureus* Cas9 molecule comprises an amino acid sequence having at least 90% sequence identity to SEQ ID NO: 26.

45. The method of claim 44, wherein in the first gRNA comprises a sequence having at least 90% sequence identity to a sequence selected from SEQ ID NOs: 2785 and 2787.

46. The method of claim 45, wherein the AAV5 vector encodes left and right ITRs having at least 90% sequence identity to SEQ ID NOs: 408 and 437.

47. The method of claim 46, wherein the AAV5 vector comprises a U6 promoter sequence having at least 90% sequence identity to SEQ ID NO: 417 and being operably coupled to a sequence encoding the first gRNA.

48. The method of claim 47, wherein the AAV5 vector comprises a promoter sequence selected from the group consisting of:

a CMV promoter sequence having at least 90% sequence identity to SEQ ID NO: 401, an EFS promoter sequence having at least 90% sequence identity to SEQ ID NO: 402, or an hGRK promoter sequence having at least 90% sequence identity to SEQ ID NO: 403.

49. The method of claim 48, wherein the first targeting domain comprises a nucleotide sequence consisting of SEQ ID NO:530 (CEP290-323) and the second targeting domain comprises a nucleotide sequence selected from the group consisting of SEQ ID NO:558 (CEP290-64) and SEQ ID NO:2321 (CEP290-11).

50. The method of claim 48, wherein the first targeting domain comprises a nucleotide sequence consisting of SEQ ID NO:468 (CEP290-490) and the second targeting domain comprises a nucleotide sequence selected from the group consisting of SEQ ID NO:460 (CEP290-496), SEQ ID NO:586 (CEP290-502), and SEQ ID NO:568 (CEP290-504).

51. The method of claim 48, wherein the first targeting domain comprises a nucleotide sequence consisting of SEQ ID NO:538 (CEP290-492) and the second targeting domain comprises a nucleotide sequence selected from the group consisting of SEQ ID NO:586 (CEP290-502) and SEQ ID NO:568 (CEP290-504).

52. The method of claim 48, wherein the first targeting domain comprises a nucleotide sequence selected from the group consisting of SEQ ID NO:530 (CEP290-323), SEQ ID NO:555 (CEP290-485), SEQ ID NO:468 (CEP290-490), and SEQ ID NO:538 (CEP290-492) and the second targeting domain comprises the nucleotide sequence consisting of SEQ ID NO:558 (CEP290-64).

53. The method of claim 48, wherein the first targeting domain comprises a nucleotide sequence selected from the group consisting of SEQ ID NO:530 (CEP290-323), SEQ ID NO:555 (CEP290-485), SEQ ID NO:468 (CEP290-490), and SEQ ID NO:538 (CEP290-492) and the second targeting domain comprises the nucleotide sequence consisting of SEQ ID NO:558 (CEP290-64).

54. The method of claim 48, wherein the first targeting domain comprises the nucleotide sequence consisting of SEQ ID NO:530 (CEP290-323) and the second targeting domain comprises the nucleotide sequence consisting of SEQ ID NO:558 (CEP290-64).

55. The method of claim 54, wherein the dose is $6\times10^{11}$ vg/mL.

56. The method of claim 54, wherein the dose is $1\times10^{12}$ vg/mL.

57. The method of claim 54, wherein the dose is $3\times10^{12}$ vg/mL.

58. A method of treating LCA10 in a subject in need thereof comprising administering to the eye of the subject:

an adeno-associated virus 5 (AAV5) vector capable of delivery to a non-dividing cell comprising:

(i) a nucleotide sequence encoding a first gRNA molecule comprising a first targeting domain comprising SEQ ID NO:530 (CEP290-323);

(ii) a nucleotide sequence encoding a second gRNA molecule comprising a second targeting domain comprising SEQ ID NO:558 (CEP290-64); and (iii) a nucleotide sequence encoding a Cas9 molecule;

wherein the AAV5 vector is administered to the subject at a dose selected from the group of AAV5 vector concentrations consisting of $6\times10^{11}$ viral genomes (vg)/mL, $1\times10^{12}$ vg/mL, and $3\times10^{12}$ vg/mL and wherein the administration results in NHEJ-mediated alteration of a LCA10 target position in the CEP290 gene in one or more cells of the subject, thereby treating the subject.

59. The method of claim 58, wherein the first gRNA molecule is configured to form a first complex with the Cas9 molecule, and the second gRNA molecule is configured to form a second complex with the Cas9 molecule, and the first complex is configured to form a first DNA double strand break between the 5' end of the Alu repeat at c.2991+1162 to c.2991.1638 of intron 26 of the CEP290 gene and 500 nucleotides upstream of the 5' end of the Alu repeat, and the second complex is configured to form a second DNA double strand break between the LCA10 target position and 500 nucleotides downstream of the LCA10 target position.

60. The method of claim 58, wherein the AAV5 recombinant viral particle is administered to a retina of the eye of the subject.

61. The method of claim 58, wherein the Cas9 molecule is an *S. aureus* Cas9 molecule.

62. The method of claim 61, wherein the *S. aureus* Cas9 molecule comprises an amino acid sequence having at least 90% sequence identity to SEQ ID NO: 26.

63. The method of claim 62, wherein in the first gRNA comprises a sequence having at least 90% sequence identity to a sequence selected from SEQ ID NOs: 2785 and 2787.

64. The method of claim 63, wherein the AAV5 vector encodes left and right ITRs having at least 90% sequence identity to SEQ ID NOs: 408 and 437.

65. The method of claim 64, wherein the AAV5 vector comprises a U6 promoter sequence having at least 90% sequence identity to SEQ ID NO: 417 and being operably coupled to a sequence encoding the first gRNA.

66. The method of claim 65, wherein the AAV5 vector comprises a promoter sequence selected from the group consisting of:
   a CMV promoter sequence having at least 90% sequence identity to SEQ ID NO: 401,
   an EFS promoter sequence having at least 90% sequence identity to SEQ ID NO: 402, or
   an hGRK promoter sequence having at least 90% sequence identity to SEQ ID NO: 403.

67. The method of claim 66, wherein the dose is $6 \times 10^{11}$ vg/mL.

68. The method of claim 66, wherein the dose is $1 \times 10^{12}$ vg/mL.

69. The method of claim 66, wherein the dose is $3 \times 10^{12}$ vg/mL.

70. The method of claim 17, wherein the AAV5 vector is administered in a volume selected from the group consisting of at least 10 microliters, at least 50 microliters, at least 100 microliters, at least 150 microliters, at least 200 microliters, at least 250 microliters, and at least 300 microliters.

71. The method of claim 18, wherein the AAV5 vector is administered in a volume selected from the group consisting of at least 10 microliters, at least 50 microliters, at least 100 microliters, at least 150 microliters, at least 200 microliters, at least 250 microliters, and at least 300 microliters.

72. The method of claim 19, wherein the AAV5 vector is administered in a volume selected from the group consisting of at least 10 microliters, at least 50 microliters, at least 100 microliters, at least 150 microliters, at least 200 microliters, at least 250 microliters, and at least 300 microliters.

73. The method of claim 36, wherein the AAV5 recombinant viral particle is volume selected from the group consisting of at least 10 microliters, at least 50 microliters, at least 100 microliters, at least 150 microliters, at least 200 microliters, at least 250 microliters, and at least 300 microliters.

74. The method of claim 37, wherein the AAV5 recombinant viral particle is administered in a volume selected from the group consisting of at least 10 microliters, at least 50 microliters, at least 100 microliters, at least 150 microliters, at least 200 microliters, at least 250 microliters, and at least 300 microliters.

75. The method of claim 38, wherein the AAV5 recombinant viral particle is administered in a volume selected from the group consisting of at least 10 microliters, at least 50 microliters, at least 100 microliters, at least 150 microliters, at least 200 microliters, at least 250 microliters, and at least 300 microliters.

76. The method of claim 55, wherein the AAV5 vector is administered in a volume selected from the group consisting of at least 10 microliters, at least 50 microliters, at least 100 microliters, at least 150 microliters, at least 200 microliters, at least 250 microliters, and at least 300 microliters.

77. The method of claim 56, wherein the AAV5 vector is administered in a volume selected from the group consisting of at least 10 microliters, at least 50 microliters, at least 100 microliters, at least 150 microliters, at least 200 microliters, at least 250 microliters, and at least 300 microliters.

78. The method of claim 57, wherein the AAV5 vector is administered in a volume selected from the group consisting of at least 10 microliters, at least 50 microliters, at least 100 microliters, at least 150 microliters, at least 200 microliters, at least 250 microliters, and at least 300 microliters.

79. The method of claim 67, wherein the AAV5 vector is administered in a volume selected from the group consisting of at least 10 microliters, at least 50 microliters, at least 100 microliters, at least 150 microliters, at least 200 microliters, at least 250 microliters, and at least 300 microliters.

80. The method of claim 68, wherein the AAV5 vector is administered in a volume selected from the group consisting of at least 10 microliters, at least 50 microliters, at least 100 microliters, at least 150 microliters, at least 200 microliters, at least 250 microliters, and at least 300 microliters.

81. The method of claim 69, wherein the AAV5 vector is administered in a volume selected from the group consisting of at least 10 microliters, at least 50 microliters, at least 100 microliters, at least 150 microliters, at least 200 microliters, at least 250 microliters, and at least 300 microliters.

82. The method of claim 70, wherein the AAV5 vector is administered in a volume of at least 100 microliters.

83. The method of claim 70, wherein the AAV5 vector is administered in a volume of at least 200 microliters.

84. The method of claim 70, wherein the AAV5 vector is administered in a volume of at least 300 microliters.

85. The method of claim 71, wherein the AAV5 vector is administered in a volume of at least 100 microliters.

86. The method of claim 71, wherein the AAV5 vector is administered in a volume of at least 200 microliters.

87. The method of claim 71, wherein the AAV5 vector is administered in a volume of at least 300 microliters.

88. The method of claim 72, wherein the AAV5 vector is administered in a volume of at least 100 microliters.

89. The method of claim 72, wherein the AAV5 vector is administered in a volume of at least 200 microliters.

90. The method of claim 72, wherein the AAV5 vector is administered in a volume of at least 300 microliters.

91. The method of claim 73, wherein the AAV5 recombinant viral particle is administered in a volume of at least 100 microliters.

92. The method of claim 73, wherein the AAV5 recombinant viral particle is administered in a volume of at least 200 microliters.

93. The method of claim 73, wherein the AAV5 recombinant viral particle is administered in a volume of at least 300 microliters.

94. The method of claim 74, wherein the AAV5 recombinant viral particle is administered in a volume of at least 100 microliters.

95. The method of claim 74, wherein the AAV5 recombinant viral particle is administered in a volume of at least 200 microliters.

96. The method of claim 74, wherein the AAV5 recombinant viral particle is administered in a volume of at least 300 microliters.

97. The method of claim 75, wherein the AAV5 recombinant viral particle is administered in a volume of at least 100 microliters.

98. The method of claim 75, wherein the AAV5 recombinant viral particle is administered in a volume of at least 200 microliters.

99. The method of claim 75, wherein the AAV5 recombinant viral particle is administered in a volume of at least 300 microliters.

100. The method of claim 76, wherein the AAV5 vector is administered in a volume of at least 100 microliters.

101. The method of claim 76, wherein the AAV5 vector is administered in a volume of at least 200 microliters.

102. The method of claim 76, wherein the AAV5 vector is administered in a volume of at least 300 microliters.

103. The method of claim 77, wherein the AAV5 vector is administered in a volume of at least 100 microliters.

104. The method of claim 77, wherein the AAV5 vector is administered in a volume of at least 200 microliters.

105. The method of claim 77, wherein the AAV5 vector is administered in a volume of at least 300 microliters.

106. The method of claim 78, wherein the AAV5 vector is administered in a volume of at least 100 microliters.

107. The method of claim 78, wherein the AAV5 vector is administered in a volume of at least 200 microliters.

108. The method of claim 78, wherein the AAV5 vector is administered in a volume of at least 300 microliters.

109. The method of claim 79, wherein the AAV5 vector is administered in a volume of at least 100 microliters.

110. The method of claim 79, wherein the AAV5 vector is administered in a volume of at least 200 microliters.

111. The method of claim 79, wherein the AAV5 vector is administered in a volume of at least 300 microliters.

112. The method of claim 80, wherein the AAV5 vector is administered in a volume of at least 100 microliters.

113. The method of claim 80, wherein the AAV5 vector is administered in a volume of at least 200 microliters.

114. The method of claim 80, wherein the AAV5 vector is administered in a volume of at least 300 microliters.

115. The method of claim 81, wherein the AAV5 vector is administered in a volume of at least 100 microliters.

116. The method of claim 81, wherein the AAV5 vector is administered in a volume of at least 200 microliters.

117. The method of claim 81, wherein the AAV5 vector is administered in a volume of at least 300 microliters.

* * * * *